United States Patent
Sarria-Millan et al.

(10) Patent No.: US 8,097,769 B2
(45) Date of Patent: Jan. 17, 2012

(54) YIELD INCREASE IN PLANTS OVEREXPRESSING THE ACCDP GENES

(75) Inventors: Rodrigo Sarria-Millan, Durham, NC (US); Eric R. Garr, Holly Springs, NC (US); Jamie Haertel, Durham, NC (US); Damian Allen, Urbana, IL (US); Bryan McKersie, Raleigh, NC (US)

(73) Assignee: BASF Plant Science GmbH (DE)

( * ) Notice: Subject to any disclaimer, the term of this patent is extended or adjusted under 35 U.S.C. 154(b) by 618 days.

(21) Appl. No.: 11/988,938

(22) PCT Filed: Jul. 13, 2006

(86) PCT No.: PCT/US2006/027117
§ 371 (c)(1),
(2), (4) Date: Mar. 12, 2008

(87) PCT Pub. No.: WO2007/011625
PCT Pub. Date: Jan. 25, 2007

(65) Prior Publication Data
US 2010/0071093 A1    Mar. 18, 2010

Related U.S. Application Data

(60) Provisional application No. 60/700,096, filed on Jul. 18, 2005.

(51) Int. Cl.
*A01H 5/00*        (2006.01)
*C12N 5/14*        (2006.01)
*C12N 15/29*       (2006.01)
*C12N 15/82*       (2006.01)
*C07H 21/04*       (2006.01)

(52) U.S. Cl. ........ 800/278; 800/283; 800/290; 800/298; 800/306; 800/312; 800/314; 800/317; 800/317.1; 800/317.2; 800/317.3; 800/317.4; 800/320; 800/320.1; 800/320.2; 800/320.3; 800/322; 800/323; 435/410; 435/320.1; 536/23.6

(58) Field of Classification Search .................. None
See application file for complete search history.

(56) References Cited

U.S. PATENT DOCUMENTS
5,466,785 A * 11/1995 de Framond .............. 536/24.1
2004/0034888 A1   2/2004 Liu et al.

FOREIGN PATENT DOCUMENTS
| EP | 1033405 A2 | 9/2000 |
|---|---|---|
| WO | WO-91/16417 A1 | 10/1991 |
| WO | WO-92/12249 A1 | 7/1992 |
| WO | WO-02/10210 A2 | 2/2002 |

OTHER PUBLICATIONS

Stearns, J., et al., "Transgenic Plants with Altered Ethylene Biosynthesis or Perception", Biotechnology Advances, vol. 21, No. 3, (2003), pp. 193-210.
Grichko, V., et al., " Increased Ability of Transgenic Plants Expressing the Bacterial Enzyme ACC Deaminase to Accumulate Cd, Co, Cu, Ni, Pb, and Zn", Journal of Biotechnology, vol. 81, No. 1, (2000), pp. 45-53.
Stearns, J., et al., "Tolerance of Transgenic Canola Expressing 1-aminocyclopropane-1-carboxylic Acid Deaminase to Growth Inhibition by Nickel", Plant Physiology and Biochemistry, vol. 43, No. 7, (2005), pp. 701-708.
Grichko, V., et al, "Flooding Tolerance of Transgenic Tomato Plants Expressing the Bacterial Enzyme ACC Deaminase Controlled by the 35S, *rolD* or PRB-1*b* Promoter", Plant Physiology and Biochemistry, vol. 39, No. 1 (2001), pp. 19-25.
Nie, L., et al., "Phytoremediation of Arsenate Contaminated Soil by Transgenic Canola and the Plant Growth-Promoting Bacterium *Enterobacter cloacae*CAL2", Plant Physiology and Biochemistry, vol. 40, No. 4, (2002), pp. 355-361.
Brown, M.E., "Seed and Root Bacterization", Ann. Rev. Phytopathol., vol. 12, (1974), pp. 181-197.
Honma, M., et al., "Metabolism of 1-Aminocyclopropane-1-carboxylic Acid", Agric. Biol. Chem., vol. 42, No. 10, (1978), pp. 1825-1831.
Jackson, M.B., "Ethylene in root Growth and Development", The Plant Hormone Ethylene, A.K. Matoo and J.C. Suttle (eds.), (1991), pp. 159-181.
Klee, H.J., et al,, "Control of Ethylene Synthesis by Expression of a Bacterial Enzyme in Transgenic Tomato Plants", The Plant Cell, vol. 3, No. 11, (1991), pp. 1187-1193.
Reed, A.J., et al., "Safety Assessment of 1-Aminocyclopropane-1-carboxylic Acid Deaminase Protein Expressed in Delayed Ripening Tomatoes", J. Agric. Food Chem., vol. 44, No. 1, (1996), pp. 388-394.
Shah, S., et al,. "Isolation and Characterization of ACC deaminase Genes from Two Different Plant Growth-Promoting Rhizobacteria", Can. J. Microbiol, vol. 44, (1998), pp. 833-843.

* cited by examiner

*Primary Examiner* — Eileen B O Hara
(74) *Attorney, Agent, or Firm* — Patricia A. McDaniels

(57) ABSTRACT

A transgenic crop plant transformed by a 1-AminoCyclopropane-1-Carboxylate Deaminase-like Polypeptide (ACCDP) coding nucleic acid, wherein expression of the nucleic acid sequence in the crop plant results in the plant's increased root growth, and/or increased yield, and/or increased tolerance to environmental stress as compared to a wild type variety of the plant. Also provided are agricultural products, including seeds, produced by the transgenic crop plants. Also provided are isolated novel ACCDPs, and isolated novel nucleic acids encoding ACCDPs, and vectors and transgenic plant containing the same.

12 Claims, 7 Drawing Sheets

Figure 1

GGGGTCGACGAAGTAATGAGAGGACGAAGCTTGACACTCTCAAGAGTAAAGCTCGAGCTTGCGAGAAG
AAGCATGTCTGCAACATCCGTACCTTCAATGGCGGATTTTCTCACCAAAAAACCTTACTCTCCTTCCTT
CTTGGGCTTCTCATCTTGTTCGGTTGCTTCCTCAGACTTCTCCCTCGCTCACCTTCCTACTCCGATC
CATCGATGGAATCTTCCTGGTCTTCCTAATGGCATAGAACTCTGGATCAAGCGAGATGATTCACCGG
AATGGAATTGAGTGGAAACAAAGTACGAAAACTCGAATTCTTAATGGCGGAAGCTGTTGATCAACACG
CTGATACTGTAATCACTATCGGCGGTATTCAGAGCAATCATTGTCGTGCTACGCCACTGCATCTAAC
TATCTTAATCTCAATCTCATCTTATTCGCCGTACTTCTAAGCTTCTTGCTGATGAAGATCCTGGATT
CGTTGGAATCTCTTGTCGAGCGTTCGTTGGAGCTAATGTTCATCTAATCTCTAAAGAAGAGTATT
CTTCCATTGGGAGTCAGCTCTTACTAATGCTCTGAAAGAGAAACTGGAAAAAGAAGGAAAGAAACCC
TATGTTATTCCAGTCGGTGGATCGACTCTTTGGGAACTTCGGGTTATATAGAAGCAGCAAGGGAAAT
TGAGGAGCAGCTGAATTATAGACCCGATGACCTGAAATTTGATGATATTGTGGTAGCATGTGGCAGTG
GTGGTACAATTGCTGGTATTTCATTGGGGTCTTGGTTGGGAGCTCTAAAAGCCAAGGTTCATGCTTTC
TCGGTTTGCGATGATCCTGATTACTTCTATGACTTTGTCCAAGGGCTTCTGGATGGACTTCACGCTGG
TGTTAACTCTCGTGATATCGTCAACATCCACAATGCCAAAGGAAAAGGATATGCCATGAACACGTCAG
AGGAGCTTGAGTTTGTAAAGAAAGTAGCAAGTTCAACTGATGTTTATTCTTGATCCGGTTTACAGTGGG
AAAGCTGCGTATGGTTTGATAAATGAGATCACCAAAGATCCCAAATGTTGGGAGGGAAGGAAGATATT
GTTCATACACACTGGTGGGCTTCTTTGGTTGTATGATAAGGTTGATCAAATGGCATCTCTGATGGGTA
ATTGGTCCCGGATGGATGTTTCAGAATCCGTTCCAAGAAAAGATGTTGTTGGCAAAATGTTCTAGCAC
AACAAAATCTGTTAATTAACCC

Figure 2

MRGRSLTLSRVKLELARRSNSATSVPSMADFLPKKPYSPPSWASHLRPLPSFTPSLAHLPTPIHRWEL
PGLPKGTELVTKRDDPTGNELSGNEVRKLEFLMAEAVDHADTVITIGGIQSNHCRATATASNYLNLN
SHLIRPSKLAADEDPGLVGNLLVERLVGANVHLI SKEEYSSIQSEALTNALKEKLEEGKKPYVIPV
GGSNSLGTWGYIEAAREISEQLNYRPDDLKFDDIVVACGSGGTIAGISLGSWLGALKAKVHAFSVCDD
PDYFYDFVQGLLLGLHAGVNSRDIVNIHNAKGKGYAMNTSEELKFVKEVASSTDVILDFVYSGKAANG
LIKRITKDPKCWEGRKILFTRTGGLLGLYDKVDQMASLMGNWSRMDVSESVPRKIEVEKMF

Figure 3

Figure 4
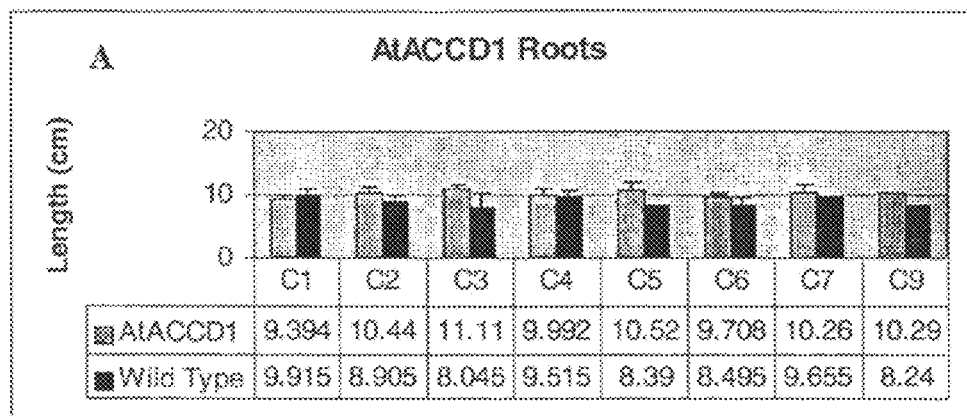
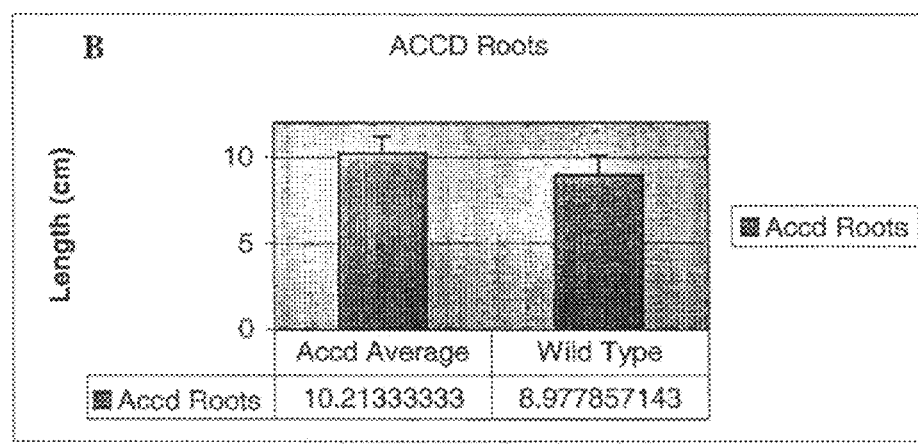
Figure 5
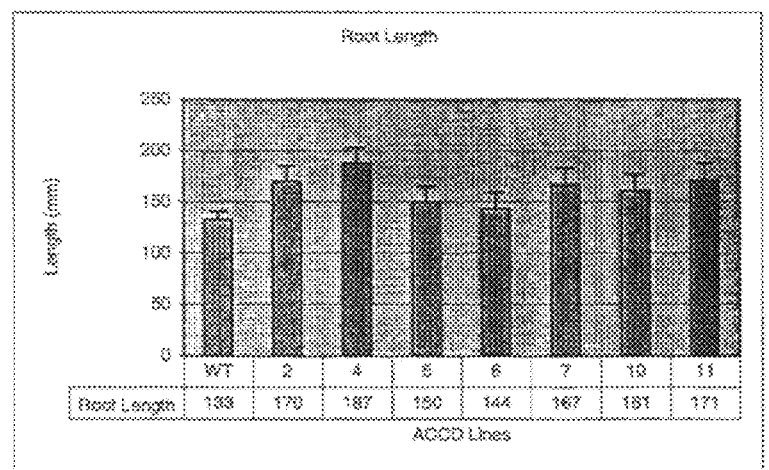

Figure 6

| Gene ID | Root Length (mm) LSMEAN | Standard Error | Diff to Control P |
|---|---|---|---|
| WT | 132.8 | 8.0 | - |
| 1.1 AtACCD | 164.3 | 6.0 | 0.0055 |

Figure 7

| Gene ID | Shoot Dry Weight (g) LSMEAN | Standard Error | Diff to Control P |
|---|---|---|---|
| WT | 0.0123 | 0.0013 | - |
| AtACCD | 0.0135 | 0.0010 | 0.8197 |

Figure 8

| Query gene | Tblasn hits (gene names and SEQ ID) | Identity percentage | Length (aa) |
|---|---|---|---|
| AtACCD(SEQ ID NO:2, 401 aa) | GmACCD-1 (SEQ ID NO:355) | 74 | 388 |
| | OsACCD (SEQ ID NO:353) | 69 | 381 |
| | ZmACCD-1 (SEQ ID NO:351) | 69 | 380 |
| | TaACCD (SEQ ID NO:357) | 67 | 401 |

Figure 9

```
>Contig1481_48982441Dec03 1406bp 11m +
         48982441.f_115_1|Soybean|Lib:AC040|cluID:7088|varID:1077
         3|RTA56564033F.1.15.1
         Length = 1406

Score =  591 bits (1523), Expect = e-168
 Identities = 288/388 (74%), Positives = 332/388 (85%)
 Frame = +2

Query: 14   ELARRSMSATSVPSMADFLTKKPYSPPSWASHLRPLPSHTFSLAHLPTPIHRWNLPGLPN 73
            EL R+SM+++        +FLTKKPYSPPSWASHL PLPSH FSLAHLPTPIHRWNLP LP
Sbjct: 50   ELVRKSMASSLG---FEFLTKKPYSPPSWASHLHPLPSHFFSLAHLPTPIHRWNLPNLPT 220

Query: 74   GTELWIKRDDFTGMELSGNKVRKLEFLMAEAVDQHADTVITIGGIQSNHCRATATASNYL 133
             TELWIKRDD +GM+LSGNKVRKLEFLMA+A+ Q AD++ITIGGIQSNHCRATA A+ YL
Sbjct: 221  NTELWIKRDDLSGMQLSGNKVRKLEFLMADAIAQGADSIITIGGIQSNHCRATAVAAKYL 400

Query: 134  NLNSHLILRTSKLLADEDPGLVGNLLVERLVGANVHLISKEEYSSIGSEALTNAXXXXXX 193
            NL+  LILRTS LL D+DPGL GNLLVER+VGA+VHLISK+EY+ IGS  LTN
Sbjct: 401  NLDCFLILRTSDLLVDQDPGLTGNLLVERMVGAHVHLISKQEYAKIGSVTLTNVLKEKLI 580

Query: 194  XXXXXPYVIPVGGSNSLGTWGYIEAAREIEEQLNYRPDDLKFDDIVVACGSGGTIAGISL 253
                 PYVIPVGGSNSLGTWGYIEA REIE+Q+        ++KFDDIVVACGSGGTIAG+SL
Sbjct: 581  KEGRRPYVIPVGGSNSLGTWGYIEAVREIEQQIQKGTGNVKFDDIVVACGSGGTIAGLSL 760

Query: 254  GSWLGALKAKVHAFSVCDDPDYFYDFVQGLLDGLHAGVNSRDIVNIHNAKGKGYAMNTSE 313
            GS L ALKA+VHAFSVCDDPDYF++F QGLLDGL AGV+SRDIV+I NAKG GYAMNTSE
Sbjct: 761  GSSLSALKARVHAFSVCDDPDYFHNFAQGLLDGLKAGVSSRDIVHIQNAKGLGYAMNTSE 940

Query: 314  ELEFVKKVASSTGVILDPVYSGKAAYGLINEITKDPKCWEGRKILFIHTGGLLGLYDKVD 373
            EL FVK+VA++TGV+LDPVYSGKAAY ++ +++++PK WE RKILFIHTGGLLGLYDKVD
Sbjct: 941  ELNFVKEVAATTGVVLDPVYSGKAAYAMLKDMSENPKKWERRKILFIHTGGLLGLYDKVD 1120

Query: 374  QMASLMGNWSRMDVSESVPRKDGVGKMF 401
            Q+AS +GNW RMDV+ESVPR+DG+GKMF
Sbjct: 1121 QLASFVGNWQRMDVNESVPRQDGIGKMF 1204
```

Figure 10

```
>Contig19555_30859453Dec03 1402bp 8m +
30859453.f_f17_1|Rice|Lib:AC003t|cluID:706|varID:779|RT
            A56560012F.f.17.1
            Length = 1402

Score =  560 bits (1442), Expect = e-159
 Identities = 266/381 (69%), Positives = 318/381 (83%)
 Frame = +2

Query: 21   SATSVPSMADFLTKKPYSPPSWASHLRPLPSHTFSLAHLPTPIHRWNLPGLPNGTELWIK 80
            +A++    +   FL+K+PY+PPSWASHL P PS TFSL H PTPIH+WNLP LPNGTE+WIK
Sbjct: 53   AASAAGKIGSFLSKRPYAPPSWASHLSPAPSQTFSLGHFPTPIHKWNLPNLPNGTEVWIK 232

Query: 81   RDDFTGMELSGNKVRKLEFLMAEAVDQHADTVITIGGIQSNHCRATATASNYLNLNSHLI 140
            RDD +GM+LSGNKVRKLEFLMA+AV Q AD VIT+GGIQSNHCRATA A+ Y+NL+ +LI
Sbjct: 233  RDDISGMQLSGNKVRKLEFLMADAVAQGADCVITVGGIQSNHCRATAVAAKYINLDCYLI 412

Query: 141  LRTSKLLADEDPGLVGNLLVERLVGANVHLISKEEYSSIGSEALTNAXXXXXXXXXXXPY 200
            LRTSKLL D+DPGLVGNLLVERLVGA++ L+SKEEY  IGS AL +              PY
Sbjct: 413  LRTSKLLVDKDPGLVGNLLVERLVGAHIDLVSKEEYGKIGSVALADLLKKKLLEEGRKPY 592

Query: 201  VIPVGGSNSLGTWGYIEAAREIEEQLNYRPDDLKFDDIVVACGSGGTIAGISLGSWLGAL 260
            VIPVGGSNSLGTWGYIEA REIE Q+      D++FDDIVVACGSGGTIAG++LGS L +L
Sbjct: 593  VIPVGGSNSLGTWGYIEAIREIEHQIQI-SGDVQFDDIVVACGSGGTIAGLALGSKLSSL 769

Query: 261  KAKVHAFSVCDDPDYFYDFVQGLLDGLHAGVNSRDIVNIHNAKGKGYAMNTSEELEFVKK 320
            KAKVHAFSVCDDP YF+ +VQ L+DGLH+ + S D+VNI NAKG GYAMNT+EEL+FVK
Sbjct: 770  KAKVHAFSVCDDPGYFHSYVQDLIDGLHSDLRSHDLVNIENAKGLGYAMNTAEELKFVKD 949

Query: 321  VASSTGVILDPVYSGKAAYGLINEITKDPKCWEGRKILFIHTGGLLGLYDKVDQMASLMG 380
            +A++TG++LDPVYSGKAAYG++ ++   +P   WEGRKILF+HTGGLLGLYDKVD+++SL G
Sbjct: 950  IATATGIVLDPVYSGKAAYGMLKDMGANPAKWEGRKILFVHTGGLLGLYDKVDELSSLSG 1129

Query: 381  NWSRMDVSESVPRKDGVGKMF 401
            +W RMD+ ESVPRKDG GKMF
Sbjct: 1130 SWRRMDLEESVPRKDGTGKMF 1192
```

Figure 11

```
>Contig14714_57817161Dec03 1383bp 4m +
57817161.f_h20_1|Maize|Lib:AC080|cluID:57802|varID:6856
         1|RTA56568132F.h.20.1
         Length = 1383

Score =  560 bits (1442), Expect = e-159
 Identities = 265/380 (69%), Positives = 319/380 (83%)
 Frame = +3

Query: 22   ATSVPSMADFLTKKPYSPPSWASHLRPLPSHTFSLAHLPTPIHRWNLPGLPNGTELWIKR 81
            +++   +   FL+KKPY+PP WA+HL P+P HTFSL H PTPIH+WNLP LP GTE+WIKR
Sbjct: 90   SSATAQIGGFLSKKPYAPPLWATHLSPMPCHTFSLGHFPTPIHKWNLPNLPEGTEVWIKR 269

Query: 82   DDFTGMELSGNKVRKLEFLMAEAVDQHADTVITIGGIQSNHCRATATASNYLNLNSHLIL 141
            DD +GM+LSGNKVRKLEFLMA+AV Q AD VIT+GGIQSNHCRATA A+ YLNL+ +LIL
Sbjct: 270  DDLSGMQLSGNKVRKLEFLMADAVAQGADCVITVGGIQSNHCRATAVAAKYLNLDCYLIL 449

Query: 142  RTSKLLADEDPGLVGNLLVERLVGANVHLISKEEYSSIGSEALTNAXXXXXXXXXXXPYV 201
            RTSKLL D+DPGLVGNLLVERLVGA+V L+SKEEY  IGS AL +              PYV
Sbjct: 450  RTSKLLVDKDPGLVGNLLVERLVGAHVDLVSKEEYGKIGSVALADLLKKRLLEEGRKPYV 629

Query: 202  IPVGGSNSLGTWGYIEAAREIEEQLNYRPDDLKFDDIVVACGSGGTIAGISLGSWLGALK 261
            IPVGGSNSLGTWGYIEA REIE+Q+ + D++FDDIVVACGSGGTIAG++LGS L +L
Sbjct: 630  IPVGGSNSLGTWGYIEAIREIEQQIQ-QSADVQFDDIVVACGSGGTIAGLALGSRLSSLN 806

Query: 262  AKVHAFSVCDDPDYFYDFVQGLLDGLHAGVNSRDIVNIHNAKGKGYAMNTSEELEFVKKV 321
            KVHAFSVCDDP+YFYD+VQGL+DGL++G++S DIV+I NAKG GYAMNT+EEL+FVK +
Sbjct: 807  TKVHAFSVCDDPEYFYDYVQGLIDGLNSGLDSHDIVSIENAKGLGYAMNTAEELKFVKDI 986

Query: 322  ASSTGVILDPVYSGKAAYGLINEITKDPKCWEGRKILFIHTGGLLGLYDKVDQMASLMGN 381
            A+STG++LDPVYSGKA YGL+ ++  +P  W+GRK+LFIHTGGLLGLYDK DQ++SL G+
Sbjct: 987  AASTGIVLDPVYSGKAVYGLLKDMAGNPAKWKGRKVLFIHTGGLLGLYDKADQLSSLAGS 1166

Query: 382  WSRMDVSESVPRKDGVGKMF 401
            .W RMD+ +SVPRKDG GKMF
Sbjct: 1167 WRRMDLEDSVPRKDGTGKMF 1226
```

Figure 12

```
>Contig15977_54201209Dec03 1463bp 5m +
54201209.f_k01_1|Wheat|Lib:AC062|cluID:9364|varID:69571
         |RTA56566095F.k.01.1
         Length = 1463

Score =  558 bits (1439), Expect = e-159
 Identities = 269/401 (67%), Positives = 324/401 (80%), Gaps = 5/401 (1%)
 Frame = +3

Query: 6     LTLSRVKLELARRSMSATSVPSMA-----DFLTKKPYSPPSWASHLRPLPSHTFSLAHLP 60
             L  R + +A M+ S  S A     FL+KKPY+PPSWASHL  PSHTFSL H P
Sbjct: 81    LAAVRRRCSIAATGMAGVSAASPAAAQIGSFLSKKPYAPPSWASHLALAPSHTFSLGHFP 260

Query: 61    TPIHRWNLPGLPNGTELWIKRDDFTGMELSGNKVRKLEFLMAEAVDQHADTVITIGGIQS 120
             TPIH+WNLP LP GTE+WIKRDD +GM+LSGNKVRKLEFL+++AV Q AD VIT+GGIQS
Sbjct: 261   TPIHKWNLPNLPEGTEVWIKRDDLSGMQLSGNKVRKLEFLLSDAVAQGADCVITVGGIQS 440

Query: 121   NHCRATATASNYLNLNSHLILRTSKLLADEDPGLVGNLLVERLVGANVHLISKEEYSSIG 180
             NHCRATA A+ YLNL+ +LILRTSKLL D+DPGLVGNLLVERL+GA++ L+SKEEY  IG
Sbjct: 441   NHCRATAVAAKYLNLDCYLILRTSKLLVDQDPGLVGNLLVERLLGAHIDLVSKEEYGKIG 620

Query: 181   SEALTNAXXXXXXXXXXXXPYVIPVGGSNSLGTWGYIEAAREIEEQLNYRPDDLKFDDIVV 240
             S AL +            PYVIPVGGSNSLGTWGYIEA RE+E+Q+      D++FDDIVV
Sbjct: 621   SVALADLLKKRLLEEGRKPYVIPVGGSNSLGTWGYIEAVRELEQQIQL-SGDVQFDDIVV 797

Query: 241   ACGSGGTIAGISLGSWLGALKAKVHAFSVCDDPDYFYDFVQGLLDGLHAGVNSRDIVNIH 300
             ACGSGGTIAG++LGS L +L AKVHAFSVCDDP+YFYD+VQGL+DGL +G++S DIV+I
Sbjct: 798   ACGSGGTIAGLALGSKLSSLTAKVHAFSVCDDPEYFYDYVQGLIDGLQSGLDSHDIVSIQ 977

Query: 301   NAKGKGYAMNTSEELEFVKKVASSTGVILDPVYSGKAAYGLINEITKDPKCWEGRKILFI 360
             NAKG GYAMNT+EEL+FVK +A++TG++LDPVYSGK AY ++  ++   +P  W+GRK+LF+
Sbjct: 978   NAKGLGYAMNTAEELKFVKDIATATGIVLDPVYSGKGAYAMLKDMADNPSKWKGRKVLFV 1157

Query: 361   HTGGLLGLYDKVDQMASLMGNWSRMDVSESVPRKDGVGKMF 401
             HTGGLLGLYDKVDQM+SL G+W RMD+ ESVPRKDG GKMF
Sbjct: 1158  HTGGLLGLYDKVDQMSSLAGSWRRMDLEESVPRKDGTGKMF 1280
```

YIELD INCREASE IN PLANTS OVEREXPRESSING THE ACCDP GENES

CROSS REFERENCE TO RELATED APPLICATIONS

This application is a national stage application (under 35 U.S.C. 371) of PCT/US2006/027117 filed Jul. 13, 2006, which claims the priority benefit of U.S. Provisional Application Ser. No. 60/700,096 filed Jul. 18, 2005, the entire content of which is hereby incorporated by reference.

BACKGROUND OF THE INVENTION

1. Field of the Invention

This invention relates generally to nucleic acid sequences encoding polypeptides that are associated with root development, which contribute to plant growth and, ultimately affect plant production (i.e. yield) under abiotic stress or non-stress conditions. In particular, this invention relates to isolated nucleic acid sequences encoding polypeptides that confer upon the plant increased root growth, increased yield, and/or increased drought, cold, and/or salt tolerance, and the use of such isolated nucleic acids.

2. Background Art

The yield of crop plants is central to the well being of humans and is directly affected by the growth of plants under physical environment. Abiotic environmental stresses, such as drought stress, salinity stress, heat stress, and cold stress, are major limiting factors of plant growth and productivity. Crop losses and crop yield losses of major crops such as soybean, rice, maize (corn), cotton, and wheat caused by these stresses represent a significant economic and political factor and contribute to food shortages in many underdeveloped countries.

Plant biomass is the total yield for forage crops like alfalfa, silage corn and hay. Many proxies for yield have been used in grain crops. Chief amongst these are estimates of plant size. Plant size can be measured in many ways depending on species and developmental stage, but include total plant dry weight, above-ground dry weight, above-ground fresh weight, leaf area, stem volume, plant height, rosette diameter, leaf length, root length, root mass, tiller number and leaf number. Many species maintain a conservative ratio between the size of different parts of the plant at a given developmental stage. These allometric relationships are used to extrapolate from one of these measures of size to another. Plant size at an early developmental stage will typically correlate with plant size later in development. A larger plant with a greater leaf area can typically absorb more light and carbon dioxide than a smaller plant and therefore will likely gain a greater weight during the same period. This is in addition to the potential continuation of the micro-environmental or genetic advantage that the plant had to achieve the larger size initially. There is a strong genetic component to plant size and growth rate, and so for a range of diverse genotypes plant size under one environmental condition is likely to correlate with size under another. In this way a standard environment is used as a proxy for the diverse and dynamic environments encountered at different locations and times by crops in the field.

Harvest index, the ratio of seed yield to above-ground dry weight, is relatively stable under many environmental conditions and so a robust correlation between plant size and grain yield can often be obtained. These processes are intrinsically linked because the majority of grain biomass is dependent on current or stored photosynthetic productivity by the leaves and stem of the plant. Therefore, selecting for plant size, even at early stages of development, has been used as an indicator for future potential. When testing for the impact of genetic differences on stress tolerance, the ability to standardize soil properties, temperature, water and nutrient availability and light intensity is an intrinsic advantage of greenhouse or plant growth chamber environments compared to the field. However, artificial limitations on yield due to poor pollination due to the absence of wind or insects, or insufficient space for mature root or canopy growth, can restrict the use of these controlled environments for testing yield differences. Therefore, measurements of plant size in early development, under standardized conditions in a growth chamber or greenhouse, are standard practices to provide indication of potential genetic yield advantages.

During the life cycle, plants are typically exposed to conditions of reduced environmental water content. Most plants have evolved strategies to protect themselves against these conditions of desiccation. However, if the severity and duration of the drought conditions are too great, the effects on development, growth, plant size, and yield of most crop plants are profound. Continuous exposure to drought conditions causes major alterations in the plant metabolism which ultimately lead to cell death and consequently yield losses.

Developing stress-tolerant plants is therefore a strategy that has the potential to solve or mediate at least some of these problems. However, traditional plant breeding strategies to develop new lines of plants that exhibit resistance and/or tolerance to these types of stresses are relatively slow and require specific resistant lines for crossing with the desired line. Limited germplasm resources for stress tolerance and incompatibility in crosses between distantly related plant species represent significant problems encountered in conventional breeding. Additionally, the cellular processes leading to drought, cold, and salt tolerance in model drought-, cold- and/or salt-tolerant plants are complex in nature- and involve multiple mechanisms of cellular adaptation and numerous metabolic pathways. This multi-component nature of stress tolerance has not only made breeding for tolerance largely unsuccessful, but has also limited the ability to genetically engineer stress tolerant plants using biotechnological methods.

Therefore, what is needed is the identification of the genes and proteins involved in these multi-component processes leading to increased growth and/or increased stress tolerance. Elucidating the function of genes expressed in stress tolerant plants will not only advance our understanding of plant adaptation and tolerance to environmental stresses, but also may provide important information for designing new strategies for crop improvement.

Roots are an important organ of higher plants. Plant root systems are fundamental to the proper growth and development of all terrestrial plant species. In addition to uptake of water and nutrients and providing physical support, roots mediate a complex but poorly understood exchange of communication between soil microbes and other plants. In agronomic systems, production is impacted by the availability of water and nutrients in the soil: root growth has a direct or indirect influence on growth and yield of aerial organs, particularly under conditions of nutrient limitation. Roots are also relevant for the production of secondary plant products, such as defense compounds and plant hormones. Establishment of proper root architecture is an important factor for the plant to effectively use the water and nutrients available in the environment and to maximize plant growth and production. In addition, under conditions of drought, roots can adapt to continue growth while at the same time producing and sending early warning signals to shoots which inhibit plant growth above ground.

Moreover, improved root growth of crop plants will also enhance competitiveness with weedy plants and will improve growth in arid areas, by increasing water accessibility and uptake. Improved root growth is also relevant for ecological purposes, such as bioremediation and prevention/arrest of soil erosion. Longer roots can alleviate not only the effects of water depletion from soil but also improve plant anchorage and standability thus reducing lodging. Also, longer roots have the ability to cover a larger volume of soil and improve nutrient uptake. Therefore, altering root biomass, and in particular increasing root length, will improve plant growth as well as increase crop yield.

Roots are also storage organs in a number of important staple crops, for example, in sugar beets, potato, manioc (cassava), yams and sweet potato (batate). Roots are also the relevant organ for consumption in a number of vegetables (e.g. carrots, radish), herbs (e.g. ginger, kukuma) and medicinal plants (e.g. ginseng). In addition, some of the secondary plant products found in roots are of economic importance for the chemical and pharmaceutical industry, for instance, the basic molecules for the synthesis of steroid hormones is found in yams, and the roots of *Lithospermum erythrorhizon* produce shikonin, which is widely used because of its anti-inflammatory, anti-tumor and wound-healing properties.

Root architecture is an area that has remained largely unexplored through classical breeding because of difficulties with assessing this trait in the field. Thus, biotechnology could have significant impact on the improvement of this trait.

The structure of root systems results from a combination of genetic predisposition and physical environment. Additionally, soil microbes can also have a beneficial effect on plant growth either by reducing the deleterious effects of other pathogenic microbes, by producing compounds promoting plant growth, or by increasing the uptake efficiency of nutrients from the environment. A microbe may use one or all of these mechanisms at different stages of the plant life cycle.

The plant hormone ethylene has been implicated in a wide spectrum of plant growth and development processes. In plants, 1-aminocyclopropane-1-carboxylate (ACC) is an essential biosynthetic precursor of ethylene. Studies in the late 70's revealed that soil bacteria expressing an ACC deaminase can reduce the levels of ethylene in the plants thus leading to root elongation (Brown, 1974, Ann. Rev. Phytopathol. 12:181-197; Honma and Shimomura, 1978, Agric. Biol. Chem. 42:1825-1831). These results were supported by experiments where genes encoding ACC deaminase were mobilized into non-growth promoting bacteria which in turn, conferred a growth promoting effect (Shah et al., 1998, Can. J. Microbiol. 44:833-843). More recently, microbial genes encoding ACC deaminase were expressed directly in transgenic plants and shown to promote root elongation (Klee et al., 1991, Plant Cell 3(11):1187-93; Reed et al., 1996, J. Ag. Food Chem. 44(1):388-394).

Although some genes that are involved in stress responses in plants have been characterized, the characterization and cloning of plant genes that confer stress tolerance remains largely incomplete and fragmented. For example, certain studies have indicated that drought and salt stress in some plants may be due to additive gene effects, in contrast to other research that indicates specific genes are transcriptionally activated in vegetative tissue of plants under osmotic stress conditions. Although it is generally assumed that stress-induced proteins have a role in tolerance, direct evidence is still lacking, and the functions of many stress-responsive genes are unknown.

There is a need, therefore, to identify additional genes expressed in stress tolerant plants that have the capacity to confer increased root growth, and/or increased yield, and/or stress tolerance to its host plant and to other plant species. Newly generated stress tolerant plants will have many advantages, such as an increased range in which the crop plants can be cultivated by, for example, decreasing the water requirements of a plant species.

SUMMARY OF THE INVENTION

This invention relates to isolated nucleic acids which encode polypeptides capable of modulating root growth, and/or plant growth, and/or yield, and/or stress tolerance under normal or stress conditions as compared to a wild type variety of the plant. In particular, the invention concerns the use of the isolated nucleic acids encode 1-AminoCyclopropane-1-Carboxylate Deaminase-like Polypeptides (ACCDPs) that are important for modulating a plant's root growth, yield, and/or response to an environmental stress. More particularly, overexpression of these ACCDP coding nucleic acids in a crop plant results in increased root growth, and/or increased yield under normal or stress conditions, and/or increased tolerance to an environmental stress.

Therefore, in a first embodiment, the invention concerns a transgenic crop plant transformed with an isolated nucleic acid, wherein the nucleic acid comprises a polynucleotide selected from the group consisting of:

a) a polynucleotide having a sequence as set forth in any of SEQ ID NOS as provided in Column No. 3 of Table 1 and Table 2;

b) a polynucleotide encoding a polypeptide having a sequence as set forth in any of SEQ ID NOS as provided in Column No. 4 of Table 1 and Table 2;

c) a polynucleotide having at least 70% sequence identity to a polynucleotide having a sequence as set forth in any of SEQ ID NOS as provided in Column No. 3 of Table 1 and Table 2;

d) a polynucleotide encoding a polypeptide having at least 70% sequence identity to a polypeptide having a sequence as set forth in any of SEQ ID NOS as provided in Column No. 4 of Table 1 and Table 2; and e) a polynucleotide that hybridizes under stringent conditions to the complement of any of the polynucleotides of a) through d) above.

Preferably, the transgenic crop plant expresses such isolated nucleic acid, so as preferably to alter the phenotype of the plants in relation to non-transformed, wild-type plants. In particular, the transgenic crop plants will exhibit modulated root growth (preferably, increased root growth), and/or plant growth, and/or yield, and/or stress tolerance under normal or stress conditions as compared to a wild type variety of the plant. Preferably, the ACCDP is from *Arabidopsis thaliana*, canola, soybean, rice, wheat, linseed, barley, sunflower or maize.

In another embodiment, the invention concerns transgenic crop plants which overexpress the ACCDP coding nucleic acid and demonstrate an increase in root growth, and more preferably, demonstrate an increase in root length under normal or stress condition as compared to a wild type variety of the plant. In one embodiment, the overexpression of the ACCDP coding nucleic acid in the plant demonstrates an increased tolerance to an environmental stress as compared to a wild-type variety of the plant. In yet another embodiment, the overexpression of the ACCDP coding nucleic acid in the plant demonstrates increased yield as compared to a wild-type variety of the plant. It is provided that the environmental stress can be salinity, drought, temperature, metal, chemical, pathogenic and oxidative stresses, or combinations thereof. Preferably, the environmental stress is drought stress.

In yet another embodiment, the invention concerns a seed produced by a transgenic crop plant transformed by an ACCDP coding nucleic acid, wherein the plant is true breeding for increased root growth, and/or increased yield, and/or increased tolerance to environmental stress as compared to a wild type variety of the plant.

In a further embodiment, the invention concerns a method of growing crop plants in an agricultural locus, wherein the method comprises obtaining the aforesaid transgenic crop plant and growing the plant in an agricultural locus.

In a still further aspect, the invention concerns product produced by or from the transgenic plants, their plant parts, or their seeds, such as a foodstuff, feedstuff, food supplement, feed supplement, cosmetic or pharmaceutical.

In another embodiment, the invention concerns a method of increasing root growth and/or yield, and/or increasing stress tolerance to an environmental stress of a crop plant under normal or stress condition as compared to a wild type variety of the plant, wherein the method comprises obtaining the aforesaid transgenic crop plant and growing the plant under a condition that the isolated nucleic acid is expressed.

In yet another embodiment, the invention concerns a method of producing the aforesaid transgenic crop plant, wherein the method comprises (a) transforming a plant cell with an expression vector comprising an ACCDP coding nucleic acid, and (b) generating from the plant cell the transgenic crop plant that expresses the encoded polypeptide. Preferably, the polynucleotide is operably linked to one or more regulatory sequences, and the expression of the polynucleotide in the plant results in increased root growth, and/or increased yield, and/or increased tolerance to environmental stress under normal or stress conditions as compared to a wild type variety of the plant. Preferably, the one or more regulatory sequences include a promoter. More preferably, the promoter is a tissue specific or developmental regulated promoter.

In a further embodiment, the invention concerns an isolated, novel ACCDP coding nucleic acid, wherein the nucleic acid comprising a polynucleotide selected from the group consisting of:

a) a polynucleotide having a sequence as set forth in any of SEQ ID NOS as provided in Column No. 3 of Table 2;

b) a polynucleotide encoding a polypeptide having a sequence as set forth in any of SEQ ID NOS as provided in Column No. 4 of Table 2;

c) a polynucleotide having at least 80% sequence identity to a polynucleotide having a sequence as set forth in any of SEQ ID NOS as provided in Column No. 3 of Table 2;

d) a polynucleotide encoding a polypeptide having at least 80% sequence identity to a polypeptide having a sequence as set forth in any of SEQ ID NOS as provided in Column No. 4 of Table 2;

e) a polynucleotide that hybridizes under stringent conditions to the complement of any of the polynucleotides of a) through d) above; and f) a polynucleotide complementary to any of the polynucleotides of a) through d) above.

In another embodiment, the invention concerns a transgenic plant transformed with such isolated nucleic acids, and a seed produced by such transgenic plant. Preferably, the transgenic plant expresses such isolated nucleic acids, so as preferably to alter the phenotype of the plants in relation to non-transformed, wild-type plants. In particular, the transgenic plant will exhibit modified (preferably, increased) root growth, and/or plant growth, and/or yield, and/or stress tolerance under normal or stress conditions as compared to a wild type variety of the plant.

In still another embodiment, the invention concerns a recombinant expression vector comprising an isolated ACCDP coding nucleic acid, wherein the nucleic acid comprises a polynucleotide selected from the group consisting of:

a) a polynucleotide having a sequence as set forth in any of SEQ ID NOS as provided in Column No. 3 of Table 1 and Table 2;

b) a polynucleotide encoding a polypeptide having a sequence as set forth in any of SEQ ID NOS as provided in Column No. 4 of Table 1 and Table 2;

c) a polynucleotide having at least 80% sequence identity to a polynucleotide having a sequence as set forth in any of SEQ ID NOS as provided in Column No. 3 of Table 1 and Table 2;

d) a polynucleotide encoding a polypeptide having at least 80% sequence identity to a polypeptide having a sequence as set forth in any of SEQ ID NOS as provided in Column No. 4 of Table 1 and Table 2;

e) a polynucleotide that hybridizes under stringent conditions to the complement of any of the polynucleotides of a) through d) above; and f) a polynucleotide complementary to any of the polynucleotides of a) through d) above.

Preferably, the polynucleotide is operably linked to one or more regulatory sequences. More preferably, the one or more regulatory sequences include a promoter. Further preferably, the promoter is a tissue specific or developmental regulated promoter.

In a further embodiment, the invention concerns a transgenic plant comprising such recombinant vector. Preferably, the expression of the ACCDP coding nucleic acid in the plant results in increased root growth, and/or increased yield, and/or increased tolerance to environmental stress as compared to a wild type variety of the plant.

In yet another embodiment, the invention concerns a method of identifying a novel ACCDP, comprising (a) raising a specific antibody response to an ACCDP, or fragment thereof, as described below; (b) screening putative ACCDP material with the antibody, wherein specific binding of the antibody to the material indicates the presence of a potentially novel ACCDP; and (c) identifying from the bound material a novel ACCDP in comparison to known ACCDP. Alternatively, hybridization with nucleic acid probes as described below can be used to identify novel ACCDP nucleic acids.

In a further embodiment, the invention also concerns methods of modifying the root growth, and/or yield, and/or stress tolerance of a plant comprising, modifying the expression of an ACCDP coding nucleic acid in the plant. Preferably, such modification results in increased or decreased root growth, and/or yield, and/or stress tolerance as compared to a wild type variety of the plant. Preferably, the root growth, and/or yield, and/or stress tolerance is increased in a plant via increasing expression of an ACCDP coding nucleic acid.

BRIEF DESCRIPTION OF THE DRAWINGS

FIG. 1 shows the nucleotide sequence of the AtACCD gene (SEQ ID NO:1; At1g48420) used for *Arabidopsis* transformation, which is 1246 bp in length. The coding region of the gene is 1203 bp in length with the start codon (i.e. ATG) and the stop codon (i.e. TAG) underlined.

FIG. 2 shows the predicted 401 amino acid sequence of the AtACCD (SEQ ID NO:2) gene used for *Arabidopsis* transformation.

FIG. 3 shows a schematic of the binary vector T-DNA used to transform the AtACCD gene (SEQ ID NO:1). LB, left border; pAHAS, *Arabidopsis* AHAS promoter; 3'AHAS, AHAS termination signal; SP, Superpromoter; AtACCD, cDNA of AtACCD; 3'NOS, termination signal; RB, Right Border.

FIGS. 4A and 4B show a plate analysis of the *Arabidopsis* AtACCD (SEQ ID NO:1) transgenic plants. 4A demonstrates that all lines showed an increased root length phenotype. Lines 2, 3, 5, 6, and 9 showed a more significant root length increase compared to the wild type controls. 4B shows the gene level analysis of the AtACCD transgenic plants, confirming that AtACCD plants exhibited an increased root length phenotype. Based on this analysis, AtACCD transgenic plants exhibited a 13.8% increase in root length. In both 4A and 4B, the attached tables show the actual mean values used to generate the bar charts.

FIG. 5 shows the in soil analysis of roots of the AtACCD (SEQ ID NO:1) plants, where the root length of AtACCD *Arabidopsis* lines was measured.

FIG. 6 shows the gene level ANOVA analysis of the AtACCD (SEQ ID NO:1) transgenic plants. The analysis data of all transgenic lines was combined to determine the overall gene performance.

FIG. 7 shows the gene level ANOVA analysis of rosette dry weights in the AtACCD (SEQ ID NO:1) transgenic plants.

FIG. 8 shows the tblastn analysis results of AtACCD (SEQ ID NO:2) against the proprietary crop sequence database. The table shows the sequence identity percentage between the amino acid sequences of AtACCD (SEQ ID NO:2) and GmACCD-1 (SEQ ID NO:355), OsACCD (SEQ ID NO:353), ZmACCD-1 (SEQ ID NO:351), or TaACCD (SEQ ID NO:357).

FIG. 9 shows the Blast alignment between the amino acid sequences of AtACCD (SEQ ID NO:2, "Query") and GmACCD (SEQ ID NO:355, "Sbjct").

FIG. 10 shows the Blast alignment between the amino acid sequences of AtACCD (SEQ ID NO:2, "Query") and OsACCD (SEQ ID NO:353, "Sbjct").

FIG. 11 shows the Blast alignment between the amino acid sequences of AtACCD (SEQ ID NO:2, "Query") and ZmACCD (SEQ ID NO:351, "Sbjct").

FIG. 12 shows the Blast alignment between the amino acid sequences of AtACCD (SEQ ID NO:2, "Query") and TaACCD (SEQ ID NO:357, "Sbjct").

DETAILED DESCRIPTION OF THE INVENTION

The present invention may be understood more readily by reference to the following detailed description of the preferred embodiments of the invention and the Examples included herein. However, before the present compounds, compositions, and methods are disclosed and described, it is to be understood that this invention is not limited to specific nucleic acids, specific polypeptides, specific cell types, specific host cells, specific conditions, or specific methods, etc., as such may, of course, vary, and the numerous modifications and variations therein will be apparent to those skilled in the art. It is also to be understood that the terminology used herein is for the purpose of describing specific embodiments only and is not intended to be limiting. In particular, the designation of the amino acid sequences as polypeptide "1-AminoCyclopropane-1-Carboxylate Deaminase-like Polypeptides" (ACCDPs), in no way limits the functionality of those sequences.

The present invention relates to ACCDPs and ACCDP coding nucleic acids that are important in increasing plant root growth, and/or yield, and/or for modulating a plant's response to an environmental stress. More particularly, overexpression of these ACCDP coding nucleic acids in a crop plant results in modulation (increase or decrease, preferably increase) in root growth, and/or increased yield, and/or increased tolerance to an environmental stress. Representative members of the ACCDP genus are AtACCD, ZmACCD, OsACCD, GmACCD, and TaACCD. In a preferred embodiment, all members of the genus are biologically active enzymes that can convert ACC to α-ketobutyrate and ammonia.

Accordingly, the present invention encompasses a transgenic crop plant comprising ACCDP polynucleotide and polypeptide sequences and a method of producing such transgenic crop plant, wherein the expression of the ACCDP polypeptide in the plant results in increased root growth, and/or yield, and/or tolerance to an environmental stress. In one embodiment, the ACCDP sequences are from a plant, preferably an *Arabidopsis* plant, a canola plant, a soybean plant, a rice plant, a barley plant, a sunflower plant, a linseed plant, a wheat plant, or a maize plant. In another embodiment, the ACCDP sequences are the genes as summarized in Table 1 and Table 2: Preferably, the disclosed ACCDP sequences have significant percent identity to known ACCDP enzymes.

TABLE 1

ACCDP genes, their origin, nucleotide sequence and corresponding amino acid sequence, and their percentage of identity shared with AtACCD (SEQ ID NO: 2) at the amino acid level (Needleman-Wunsch algorithm for global sequence alignment, J. Mol. Biol. 48(3): 443-53; Matrix: Blosum 62; Gap opening penalty: 10.0; Gap extension penalty: 2.0).

| Column No. 1 Gene Name | Column No. 2 Organism | Column No. 3 Nucleotide SEQ ID NO: | Column No. 4 Amino acide SEQ ID NO: | Column No. 5 Identity to AtACCD (%) |
|---|---|---|---|---|
| AtACCD | *Arabidopsis thaliana* | 1 | 2 | 100 |
| BPS_WIPO_PROT|SL000001.11101 | *Arabidopsis thaliana* |  | 3 | 70 |
| BPS_WIPO_PROT|US20040123343A1.159474 | *Oryza sativa* | 4 | 5 | 31 |
| BPS_WIPO_PROT|US20040214272A1.227458 | *Zea mays* | 6 | 7 | 35 |
| BPS_WIPO_PROT|US20040214272A1.227458 | *Zea mays* | 8 | 9 | 69 |
| AP_002534 | *Escherichia coli* | 10 | 11 | 29 |
| NP_142071 | *Pyrococcus horikoshii* | 12 | 13 | 30 |
| NP_281783 | *Campylobacter jejuni* | 14 | 15 | 20 |
| NP_288380 | *Escherichia coli* | 16 | 17 | 31 |

TABLE 1-continued

ACCDP genes, their origin, nucleotide sequence and corresponding amino acid sequence,
and their percentage of identity shared with AtACCD (SEQ ID NO: 2) at the amino acid level
(Needleman-Wunsch algorithm for global sequence alignment, J. Mol. Biol. 48(3): 443-53; Matrix:
Blosum 62; Gap opening penalty: 10.0; Gap extension penalty: 2.0).

| Column No. 1<br>Gene Name | Column No. 2<br>Organism | Column No. 3<br>Nucleotide<br>SEQ ID NO: | Column No. 4<br>Amino acide<br>SEQ ID NO: | Column No. 5<br>Identity to<br>AtACCD (%) |
|---|---|---|---|---|
| NP_420839 | *Caulobacter crescentus* | 18 | 19 | 30 |
| NP_456516 | *Salmonella enterica* | 20 | 21 | 29 |
| NP_460906 | *Salmonella typhimurium* | 22 | 23 | 30 |
| NP_488487 | *Nostoc* sp. | 24 | 25 | 22 |
| NP_577739 | *Pyrococcus furiosus* | 26 | 27 | 30 |
| NP_669768 | *Yersinia pestis* | 28 | 29 | 28 |
| NP_707806 | *Shigella flexneri* 2a str. | 30 | 31 | 30 |
| NP_744159 | *Pseudomonas putida* | 32 | 33 | 20 |
| NP_754225 | *Escherichia coli* | 34 | 35 | 29 |
| NP_794910 | *Pseudomonas syringae* | 36 | 37 | 27 |
| NP_822695 | *Streptomyces avermitilis* | 38 | 39 | 29 |
| NP_824185 | *Streptomyces avermitilis* | 40 | 41 | 21 |
| NP_832957 | *Bacillus cereus* | 42 | 43 | 30 |
| NP_845541 | *Bacillus anthracis* | 44 | 45 | 30 |
| NP_891079 | *Bordetella bronchiseptica* | 46 | 47 | 29 |
| NP_917071 | *Oryza sativa* | 48 | 49 | 21 |
| NP_979563 | *Bacillus cereus* | 50 | 51 | 29 |
| XP_366736 | *Magnaporthe grisea* | 52 | 53 | 28 |
| XP_382854 | *Gibberella zeae* | 54 | 55 | 24 |
| XP_468034 | *Oryza sativa* | 56 | 57 | 68 |
| XP_682168 | *Aspergillus nidulans* | 58 | 59 | 23 |
| XP_748001 | *Aspergillus fumigatus* | 60 | 61 | 26 |
| XP_749239 | *Aspergillus fumigatus* | 62 | 63 | 25 |
| XP_782004 | *Strongylocentrotus purpuratus* | 64 | 65 | 37 |
| XP_783308 | *Strongylocentrotus purpuratus* | 66 | 67 | 38 |
| XP_787534 | *Strongylocentrotus purpuratus* | 68 | 69 | 39 |
| XP_797948 | *Strongylocentrotus purpuratus* | 70 | 71 | 38 |
| XP_959200 | *Neurospora crassa* | 72 | 73 | 24 |
| YP_011858 | *Desulfovibrio vulgaris* | 74 | 75 | 26 |
| YP_037315 | *Bacillus thuringiensis* | 76 | 77 | 30 |
| YP_045480 | *Acinetobacter* sp. | 78 | 79 | 23 |
| YP_049633 | *Erwinia carotovora* | 80 | 81 | 31 |
| YP_065241 | *Desulfotalea psychrophila* | 82 | 83 | 27 |
| YP_065245 | *Desulfotalea psychrophila* | 84 | 85 | 28 |
| YP_070243 | *Yersinia pseudotuberculosis* | 86 | 87 | 28 |
| YP_084517 | *Bacillus cereus* | 88 | 89 | 30 |
| YP_103707 | *Burkholderia mallei* | 90 | 91 | 27 |
| YP_109214 | *Burkholderia pseudomallei* | 92 | 93 | 27 |
| YP_150207 | *Salmonella enterica* | 94 | 95 | 30 |
| YP_164989 | *Silicibacter pomeroyi* | 96 | 97 | 32 |
| YP_167867 | *Silicibacter pomeroyi* | 98 | 99 | 33 |
| YP_216944 | *Salmonella enterica* | 100 | 101 | 30 |
| YP_233469 | *Pseudomonas syringae* | 102 | 103 | 27 |
| YP_234762 | *Pseudomonas syringae* | 104 | 105 | 21 |
| YP_234886 | *Pseudomonas syringae* | 106 | 107 | 24 |
| YP_257395 | *Pseudomonas fluorescens* | 108 | 109 | 27 |
| YP_264886 | *Psychrobacter arcticus* | 110 | 111 | 29 |
| YP_271227 | *Colwellia psychrerythraea* | 112 | 113 | 23 |

TABLE 1-continued

ACCDP genes, their origin, nucleotide sequence and corresponding amino acid sequence, and their percentage of identity shared with AtACCD (SEQ ID NO: 2) at the amino acid level (Needleman-Wunsch algorithm for global sequence alignment, J. Mol. Biol. 48(3): 443-53; Matrix: Blosum 62; Gap opening penalty: 10.0; Gap extension penalty: 2.0).

| Column No. 1 Gene Name | Column No. 2 Organism | Column No. 3 Nucleotide SEQ ID NO: | Column No. 4 Amino acide SEQ ID NO: | Column No. 5 Identity to AtACCD (%) |
|---|---|---|---|---|
| YP_272646 | *Pseudomonas syringae* | 114 | 115 | 27 |
| YP_273913 | *Pseudomonas syringae* | 116 | 117 | 22 |
| YP_273996 | *Pseudomonas syringae* | 118 | 119 | 24 |
| YP_297784 | *Ralstonia eutropha* | 120 | 121 | 26 |
| YP_300428 | *Staphylococcus saprophyticus* | 122 | 123 | 32 |
| YP_310154 | *Shigella sonnei* | 124 | 125 | 29 |
| YP_321891 | *Anabaena variabilis* | 126 | 127 | 23 |
| YP_335503 | *Burkholderia pseudomallei* | 128 | 129 | 24 |
| YP_341190 | *Pseudoalteromonas haloplanktis* | 130 | 131 | 24 |
| YP_345978 | *Pseudomonas fluorescens* | 132 | 133 | 27 |
| YP_366559 | *Burkholderia* sp. | 134 | 135 | 30 |
| YP_373615 | *Burkholderia* sp. | 136 | 137 | 25 |
| YP_389072 | *Desulfovibrio desulfuricans* | 138 | 139 | 28 |
| YP_391222 | *Thiomicrospira crunogena* | 140 | 141 | 22 |
| YP_402750 | *Shigella dysenteriae* | 142 | 143 | 30 |
| YP_407560 | *Shigella boydii* | 144 | 145 | 31 |
| YP_435720 | *Hahella chejuensis* | 146 | 147 | 22 |
| YP_439298 | *Burkholderia thailandensis* | 148 | 149 | 24 |
| YP_454591 | *Sodalis glossinidius* | 150 | 151 | 26 |
| YP_464642 | *Anaeromyxobacter dehalogenans* | 152 | 153 | 32 |
| YP_510818 | *Jannaschia* sp. | 154 | 155 | 26 |
| YP_527135 | *Saccharophagus degradans* | 156 | 157 | 34 |
| YP_527202 | *Saccharophagus degradans* | 158 | 159 | 23 |
| YP_541124 | *Escherichia coli* | 160 | 161 | 29 |
| YP_548994 | *Polaromonas* sp. | 162 | 163 | 26 |
| YP_550624 | *Polaromonas* sp. | 164 | 165 | 25 |
| YP_554094 | *Burkholderia xenovorans* | 166 | 167 | 24 |
| YP_581089 | *Psychrobacter cryohalolentis* | 168 | 169 | 29 |
| ZP_00105754 | *Nostoc punctiforme* | 170 | 171 | 22 |
| ZP_00204949 | *Pseudomonas aeruginosa* | 172 | 173 | 21 |
| ZP_00235416 | *Bacillus cereus* | 174 | 175 | 30 |
| ZP_00241961 | *Rubrivivax gelatinosus* | 176 | 177 | 24 |
| ZP_00308173 | *Cytophaga hutchinsonii* | 178 | 179 | 24 |
| ZP_00378456 | *Brevibacterium linens* | 180 | 181 | 30 |
| ZP_00378517 | *Brevibacterium linens* | 182 | 183 | 25 |
| ZP_00422441 | *Burkholderia vietnamiensis* | 184 | 185 | 24 |
| ZP_00452460 | *Burkholderia cenocepacia* | 186 | 187 | 24 |
| ZP_00619434 | *Kineococcus radiotolerans* | 188 | 189 | 29 |
| ZP_00655563 | *Nocardioides* sp. | 190 | 191 | 26 |
| ZP_00655579 | *Nocardioides* sp. | 192 | 193 | 24 |
| ZP_00666038 | *Syntrophobacter fumaroxidans* | 194 | 195 | 28 |
| ZP_00686013 | *Burkholderia ambifaria* | 196 | 197 | 24 |
| ZP_00695539 | *Shigella boydii* | 198 | 199 | 29 |
| ZP_00704208 | *Escherichia coli* | 200 | 201 | 30 |
| ZP_00706049 | *Escherichia coli* | 202 | 203 | 29 |
| ZP_00715158 | *Escherichia coli* | 204 | 205 | 29 |
| ZP_00774185 | *Pseudoalteromonas atlantica* | 206 | 207 | 22 |

TABLE 1-continued

ACCDP genes, their origin, nucleotide sequence and corresponding amino acid sequence, and their percentage of identity shared with AtACCD (SEQ ID NO: 2) at the amino acid level (Needleman-Wunsch algorithm for global sequence alignment, J. Mol. Biol. 48(3): 443-53; Matrix: Blosum 62; Gap opening penalty: 10.0; Gap extension penalty: 2.0).

| Column No. 1 Gene Name | Column No. 2 Organism | Column No. 3 Nucleotide SEQ ID NO: | Column No. 4 Amino acide SEQ ID NO: | Column No. 5 Identity to AtACCD (%) |
|---|---|---|---|---|
| ZP_00774405 | *Pseudoalteromonas atlantica* | 208 | 209 | 32 |
| ZP_00777501 | *Pseudoalteromonas atlantica* | 210 | 211 | 28 |
| ZP_00791500 | *Yersinia pseudotuberculosis* | 212 | 213 | 28 |
| ZP_00799744 | *Alkaliphilus metalliredigenes* | 214 | 215 | 35 |
| ZP_00808738 | *Rhodopseudomonas palustris* | 216 | 217 | 30 |
| ZP_00861350 | *Bradyrhizobium* sp. | 218 | 219 | 24 |
| ZP_00923697 | *Escherichia coli* | 220 | 221 | 29 |
| ZP_00944339 | *Ralstonia solanacearum* | 222 | 223 | 24 |
| ZP_00959540 | *Roseovarius nubinhibens* | 224 | 225 | 25 |
| ZP_00961132 | *Roseovarius nubinhibens* | 226 | 227 | 30 |
| ZP_00968640 | *Pseudomonas aeruginosa* | 228 | 229 | 21 |
| ZP_00974363 | *Pseudomonas aeruginosa* | 230 | 231 | 21 |
| ZP_00976764 | *Burkholderia cenocepacia* | 232 | 233 | 22 |
| ZP_00978652 | *Burkholderia cenocepacia* | 234 | 235 | 25 |
| ZP_00983649 | *Burkholderia dolosa* | 236 | 237 | 25 |
| ZP_01019104 | *Polaromonas naphthalenivorans* | 238 | 239 | 26 |
| ZP_01027677 | *Burkholderia mallei* | 240 | 241 | 27 |
| ZP_01035983 | *Roseovarius* sp. | 242 | 243 | 29 |
| ZP_01037089 | *Roseovarius* sp. | 244 | 245 | 32 |
| ZP_01050656 | *Cellulophaga* sp. | 246 | 247 | 24 |
| ZP_01053873 | *Tenacibaculum* sp | 248 | 249 | 25 |
| ZP_01060636 | *Flavobacterium* sp. | 250 | 251 | 24 |
| ZP_01070075 | *Campylobacter jejuni* | 252 | 253 | 20 |
| ZP_01074915 | *Marinomonas* sp. | 254 | 255 | 20 |
| ZP_01102706 | gamma proteobacterium | 256 | 257 | 30 |
| ZP_01104195 | gamma proteobacterium | 258 | 259 | 26 |
| ZP_01107544 | *Flavobacteriales bacterium* | 260 | 261 | 25 |
| ZP_01110185 | *Alteromonas macleodii* | 262 | 263 | 21 |
| ZP_01116950 | *Polaribacter irgensii* | 264 | 265 | 24 |
| ZP_01120549 | *Robiginitalea biformata* | 266 | 267 | 23 |
| ZP_01129787 | marine actinobacterium | 268 | 269 | 24 |
| ZP_01150242 | *Desulfotomaculum reducens* | 270 | 271 | 28 |
| ZP_01150249 | *Desulfotomaculum reducens* | 272 | 273 | 29 |
| ZP_01168090 | *Oceanospirillum* sp. | 274 | 275 | 21 |
| ZP_01184367 | *Bacillus weihenstephanensis* | 276 | 277 | 31 |
| ZP_01196859 | *Xanthobacter autotrophicus* | 278 | 279 | 26 |
| ZP_01200770 | *Xanthobacter autotrophicus* | 280 | 281 | 27 |
| ZP_01201978 | *Flavobacteria bacterium* | 282 | 283 | 24 |
| ZP_01223813 | marine gamma | 284 | 285 | 34 |
| ZP_01246005 | *Flavobacterium johnsoniae* | 286 | 287 | 24 |
| ZP_01252717 | *Psychroflexus torquis* | 288 | 289 | 24 |
| ZP_01296455 | *Pseudomonas aeruginosa* | 290 | 291 | 21 |
| Q1WLF4_RHIME | *Rhizobium meliloti* | 292 | 293 | 24 |
| Q2U8N3_ASPOR | *Aspergillus oryzae* | 294 | 295 | 27 |

TABLE 1-continued

ACCDP genes, their origin, nucleotide sequence and corresponding amino acid sequence, and their percentage of identity shared with AtACCD (SEQ ID NO: 2) at the amino acid level (Needleman-Wunsch algorithm for global sequence alignment, J. Mol. Biol. 48(3): 443-53; Matrix: Blosum 62; Gap opening penalty: 10.0; Gap extension penalty: 2.0).

| Column No. 1 Gene Name | Column No. 2 Organism | Column No. 3 Nucleotide SEQ ID NO: | Column No. 4 Amino acide SEQ ID NO: | Column No. 5 Identity to AtACCD (%) |
| --- | --- | --- | --- | --- |
| Q2UA44_ASPOR | Aspergillus oryzae | 296 | 297 | 25 |
| Q872C9_NEUCR | Neurospora crassa | 298 | 299 | 26 |
| Q8KJA8_RHILO | Rhizobium loti | 300 | 301 | 24 |
| Q8W4C7_ARATH | Arabidopsis thaliana | 302 | 303 | 95 |
| Q9P964_PENCI | Penicillium citrinum | 304 | 305 | 25 |
| Q9SX74_ARATH | Arabidopsis thaliana | 306 | 307 | 96 |
| 1A1D_BRAJA | Bradyrhizobium japonicum | 308 | 309 | 24 |
| 1A1D_BURMA | Burkholderia mallei | 310 | 311 | 24 |
| 1A1D_CRYNE | Cryptococcus neoformans | 312 | 313 | 25 |
| 1A1D_ENTCL | Enterobacter cloacae | 314 | 315 | 23 |
| 1A1D_PSEFL | Pseudomonas fluorescens | 316 | 317 | 25 |
| 1A1D_PSEPU | Pseudomonas putida | 318 | 319 | 24 |
| 1A1D_PSES0 | Pseudomonas sp Pseudomonas | 320 | 321 | 24 |
| 1A1D_PSESM | Pseudomonas syringae | 322 | 323 | 24 |
| 1A1D_PSEUD | Pseudomonas sp | 324 | 325 | 24 |
| 1A1D_PYRAB | Pyrococcus abyssi | 326 | 327 | 30 |
| 1A1D_RALSO | Ralstonia solanacearum | 328 | 329 | 24 |
| 1A1D_RHILO | Rhizobium loti | 330 | 331 | 23 |
| 1A1D_RHILV | Rhizobium leguminosarum | 332 | 333 | 24 |
| 1A1D_SCHPO | Schizosaccharomyces pombe | 334 | 335 | 27 |
| 1A1D_THEMA | Thermotoga maritima | 336 | 337 | 32 |
| 1A1D_VARPD | Variovorax paradoxus | 338 | 339 | 23 |
| DCYD_YERPE | Yersinia pestis | 340 | 341 | 28 |

TABLE 2

Novel ACCDP genes, their origin, nucleotide sequence and corresponding amino acid sequence, and their percentage of identity shared with AtACCD (SEQ ID NO: 2) at the amino acid level (Needleman-Wunsch algorithm for global sequence alignment, J. Mol. Biol. 48(3): 443-53; Matrix: Blosum 62; Gap opening penalty: 10.0; Gap extension penalty: 2.0).

| Column No. 1 Gene Name | Column No. 2 Organism | Column No. 3 Nucleotide SEQ ID NO: | Column No. 4 Amino acide SEQ ID NO: | Column No. 5 Identity to AtACCD (%) |
| --- | --- | --- | --- | --- |
| GmACCD-2 (48982441_singleclone) | Glycine max | 342 | 343 | 72 |
| BnACCD (49287365_singleclone) | Brassica napus | 344 | 345 | 86 |
| ZmACCD-2 (62053108_singleclone) | Zea mays | 346 | 347 | 68 |
| ZmACCD-3 (62053108_singlecloneDLM) | Zea mays | 348 | 349 | 57 |
| ZmACCD-1 | Zea mays | 350 | 351 | 69 |
| OsACCD | rice | 352 | 353 | 69 |
| GmACCD-1 | Glycine max | 354 | 355 | 74 |
| TaACCD | wheat | 356 | 357 | 67 |

The present invention further encompasses novel ACCDP polynucleotide and polypeptide sequences and their use for increasing a plant's root growth, and/or yield, and/or tolerance to an environmental stress. In this embodiment, the ACCDP sequences are from canola, soybean, rice, wheat or maize, or homologous thereto. Preferably in this embodiment, the ACCDP polynucleotide and polypeptide sequences are those from canola, soybean, rice, wheat or maize as set forth in any of SEQ ID NOS as provided in Column Nos. 3 and 4 of Table 2.

The present invention provides a transgenic plant transformed by an ACCDP coding nucleic acid, wherein expression of the nucleic acid sequence in the plant results in increased root growth, and/or increased yield, and/or increased tolerance to an environmental stress as compared to a wild type variety of the plant. In particular, the increased root growth is an increase in the length of the roots. The term "plant" as used herein can, depending on context, be understood to refer to whole plants, plant cells, and plant parts including seeds. The word "plant" also refers to any plant, particularly, to seed plant, and may include, but not limited to, crop plants. Plant parts include, but are not limited to, stems, roots, ovules, stamens, leaves, embryos, meristematic regions, callus tissue, gametophytes, sporophytes, pollen, microspores, and the like. In one embodiment, the transgenic plant is male sterile. Also provided is a plant seed produced by a transgenic plant transformed by an ACCDP coding nucleic acid, wherein the seed contains the ACCDP coding nucleic acid, and wherein the plant is true breeding for increased root growth, and/or increased yield, and/or increased tolerance to environmental stress as compared to a wild type variety of the plant. The invention further provides a seed produced by a transgenic plant expressing an ACCDP, wherein the seed contains the ACCDP, and wherein the plant is true breeding for increased root growth, and/or increased yield, and/or increased tolerance to environmental stress as compared to a wild type variety of the plant. The invention also provides a product produced by or from the transgenic plants expressing the ACCDP coding nucleic acid, their plant parts, or their seeds. The product can be obtained using various methods well known in the art. As used herein, the word "product" includes, but not limited to, a foodstuff, feedstuff, a food supplement, feed supplement, cosmetic or pharmaceutical. Foodstuffs are regarded as compositions used for nutrition. These also include compositions for supplementing nutrition. Animal feedstuffs and animal feed supplements, in particular, are regarded as foodstuffs. The invention further provides an agricultural product produced by any of the transgenic plants, plant parts, and plant seeds. Agricultural products include, but are not limited to, plant extracts, proteins, amino acids, carbohydrates, fats, oils, polymers, vitamins, and the like.

As used herein, the term "variety" refers to a group of plants within a species that share constant characters that separate them from the typical form and from other possible varieties within that species. While possessing at least one distinctive trait, a variety is also characterized by some variation between individuals within the variety, based primarily on the Mendelian segregation of traits among the progeny of succeeding generations. A variety is considered "true breeding" for a particular trait if it is genetically homozygous for that trait to the extent that, when the true-breeding variety is self-pollinated, a significant amount of independent segregation of the trait among the progeny is not observed. In the present invention, the trait arises from the transgenic expression of one or more DNA sequences introduced into a plant variety.

The crop plants according to the invention will be understood to include dicotyledonous crop plants such as, for example, from the families of the Leguminosae such as pea, alfalfa and soybean; the family of the Umbelliferae, particularly the genus *Daucus* (very particularly the species *carota* (carrot)) and *Apium* (very particularly the species *graveolens*. var. *dulce* (celery)) and many others; the family of the Solanaceae, particularly the genus *Lycopersicon*, very particularly the species *esculentum* (tomato) and the genus *Solanum*, very particularly the species *tuberosum* (potato) and *melongena* (aubergine), tobacco and many others; and the genus *Capsicum*, very particularly the species *annum* (pepper) and many others; the family of the Leguminosae, particularly the genus *Glycine*, very particularly the species *max* (soybean) and many others; and the family of the Cruciferae, particularly the genus *Brassica*, very particularly the species *napus* (oilseed rape), *campestris* (beet), *oleracea* cv Tastie (cabbage), *oleracea* cv Snowball Y (cauliflower) and *oleracea* cv Emperor (broccoli); and the genus *Arabidopsis*, very particularly the species *thaliana* and many others; the family of the Compositae, particularly the genus *Lactuca*, very particularly the species *sativa* (lettuce) and many others; and the family of the Malvaceae, particularly the genus *Gossypium*, very particularly the species known as cotton; and the family of the Fabaceae, particularly the genus *Arachis*, very particularly the species *hypogaea* (peanut).

The crop plants according to the invention also include monocotyledonous crop plants, such as, for example, cereals such as wheat, barley, sorghum and millet, rye, triticale, maize, rice or oats, and sugarcane. Further preferred are trees such as apple, pear, quince, plum, cherry, peach, nectarine, apricot, papaya, mango, and other woody species including coniferous and deciduous trees such as poplar, pine, *sequoia*, cedar, oak, etc. Especially preferred are *Arabidopsis thaliana, Nicotiana tabacum*, oilseed rape, soybean, corn (maize), wheat, linseed, potato and tagetes.

The present invention describes for the first time that the ACCDP is useful for increasing a crop plant's root growth, and/or yield, and/or tolerance to environmental stress. As used herein, the term polypeptide refers to a chain of at least four amino acids joined by peptide bonds. The chain may be linear, branched, circular, or combinations thereof. Accordingly, the present invention provides for use in crop plants of isolated ACCDPs selected from any of the organisms as provided in Column No. 2 of Table 1 and Table 2, and homologs thereof. In preferred embodiments, the ACCDP is selected from: 1) any of ACCDP polypeptides as provided in Column No. 4 of Table 1 and Table 2; and 2) homologs and orthologs thereof. Homologs and orthologs of the amino acid sequences are defined below.

The ACCDPs of the present invention are preferably produced by recombinant DNA techniques. For example, a nucleic acid molecule encoding the polypeptide is cloned into an expression vector (as described below), the expression vector is introduced into a host cell (as described below) and the ACCDP is expressed in the host cell. The ACCDP can then be isolated from the cells by an appropriate purification scheme using standard polypeptide purification techniques. For the purposes of the invention, the term "recombinant polynucleotide" refers to a polynucleotide that has been altered, rearranged, or modified by genetic engineering. Examples include any cloned polynucleotide, and polynucleotides that are linked or joined to heterologous sequences. The term "recombinant" does not refer to alterations to polynucleotides that result from naturally occurring events, such as spontaneous mutations. Alternative to recombinant expression, an ACCDP, or peptide thereof, can be synthesized chemically using standard peptide synthesis techniques. Moreover, native ACCDP can be isolated from cells (e.g., *Arabidopsis thaliana* cells), for example using an anti-ACCDP antibody, which can be produced by standard techniques utilizing an ACCDP or fragment thereof.

As used herein, the term "environmental stress" refers to sub-optimal conditions associated with salinity, drought, temperature, metal, chemical, pathogenic and oxidative stresses, or combinations thereof. In preferred embodiments, the environmental stress can be selected from one or more of the group consisting of salinity, drought, or temperature, or combinations thereof, and in particular, can be selected from one or more of the group consisting of high salinity, low water content (drought), or low temperature. In a more preferred embodiment, the environmental stress is drought stress. As also used herein, the term "water use efficiency" refers to the amount of organic matter produced by a plant divided by the amount of water used by the plant in producing it, i.e. the dry weight of a plant in relation to the plant's water use. As used herein, the term "dry weight" refers to everything in the plant other than water, and includes, for example, carbohydrates, proteins, oils, and mineral nutrients. It is also to be understood that as used in the specification and in the claims, "a" or "an" can mean one or more, depending upon the context in which it is used. Thus, for example, reference to "a cell" can mean that at least one cell can be utilized.

As also used herein, the term "nucleic acid" and "polynucleotide" refer to RNA or DNA that is linear or branched, single or double stranded, or a hybrid thereof. The term also encompasses RNA/DNA hybrids. These terms also encompass untranslated sequence located at both the 3' and 5' ends of the coding region of the gene: at least about 1000 nucleotides of sequence upstream from the 5' end of the coding region and at least about 200 nucleotides of sequence downstream from the 3' end of the coding region of the gene. Less common bases, such as inosine, 5-methylcytosine, 6-methyladenine, hypoxanthine, and others can also be used for antisense, dsRNA, and ribozyme pairing. For example, polynucleotides that contain C-5 propyne analogues of uridine and cytidine have been shown to bind RNA with high affinity and to be potent antisense inhibitors of gene expression. Other modifications, such as modification to the phosphodiester backbone, or the 2'-hydroxy in the ribose sugar group of the RNA can also be made. The antisense polynucleotides and ribozymes can consist entirely of ribonucleotides, or can contain mixed ribonucleotides and deoxyribonucleotides. The polynucleotides of the invention may be produced by any means, including genomic preparations, cDNA preparations, in vitro synthesis, RT-PCR, and in vitro or in vivo transcription.

An "isolated" nucleic acid molecule is one that is substantially separated from other nucleic acid molecules, which are present in the natural source of the nucleic acid (i.e., sequences encoding other polypeptides). Preferably, an "isolated" nucleic acid is free of some of the sequences, which naturally flank the nucleic acid (i.e. sequences located at the 5' and 3' ends of the nucleic acid) in its naturally occurring replicon. For example, a cloned nucleic acid is considered isolated. In various embodiments, the isolated ACCDP coding nucleic acid molecule can contain less than about 5 kb, 4 kb, 3 kb, 2 kb, 1 kb, 0.5 kb, or 0.1 kb of nucleotide sequences which naturally flank the nucleic acid molecule in genomic DNA of the cell from which the nucleic acid is derived (e.g., an *Arabidopsis thaliana* cell). A nucleic acid is also considered isolated if it has been altered by human intervention, or placed in a locus or location that is not its natural site, or if it is introduced into a cell by agroinfection. Moreover, an "isolated" nucleic acid molecule, such as a cDNA molecule, can be free from some of the other cellular material with which it is naturally associated, or culture medium when produced by recombinant techniques, or chemical precursors or other chemicals when chemically synthesized.

Specifically excluded from the definition of "isolated nucleic acids" are: naturally-occurring chromosomes (such as chromosome spreads), artificial chromosome libraries, genomic libraries, and cDNA libraries that exist either as an in vitro nucleic acid preparation or as a transfected/transformed host cell preparation, wherein the host cells are either an in vitro heterogeneous preparation or plated as a heterogeneous population of single colonies. Also specifically excluded are the above libraries wherein a specified nucleic acid makes up less than 5% of the number of nucleic acid inserts in the vector molecules. Further specifically excluded are whole cell genomic DNA or whole cell RNA preparations (including whole cell preparations that are mechanically sheared or enzymatically digested). Even further specifically excluded are the whole cell preparations found as either an in vitro preparation or as a heterogeneous mixture separated by electrophoresis wherein the nucleic acid of the invention has not further been separated from the heterologous nucleic acids in the electrophoresis medium (e.g., further separating by excising a single band from a heterogeneous band population in an agarose gel or nylon blot).

A nucleic acid molecule according to the present invention, e.g., a nucleic acid molecule having a nucleotide sequence as set forth in any of SEQ ID NOS as provided in Column No. 3 of Table 1 and Table 2, or a portion thereof, can be isolated using standard molecular biology techniques and the sequence information provided herein. For example, an ACCDP cDNA can be isolated from any crop library using all or a portion of any of SEQ ID NOS as provided in Column No. 3 of Table 1 and Table 2. Moreover, a nucleic acid molecule encompassing all or a portion of any of SEQ ID NOS as provided in Column No. 3 of Table 1 and Table 2 can be isolated by the polymerase chain reaction using oligonucleotide primers designed based upon this sequence. For example, mRNA can be isolated from plant cells (e.g., by the guanidinium-thiocyanate extraction procedure of Chirgwin et al., 1979, Biochemistry 18:5294-5299), and cDNA can be prepared using reverse transcriptase (e.g., Moloney MLV reverse transcriptase, available from Gibco/BRL, Bethesda, Md.; or AMV reverse transcriptase, available from Seikagaku America, Inc., St. Petersburg, Fla.). Synthetic oligonucleotide primers for polymerase chain reaction amplification can be designed based upon the nucleotide sequence as set forth in any of sequences shown in Column No. 3 of Table 1 and Table 2. A nucleic acid molecule of the invention can be amplified using cDNA or, alternatively, genomic DNA, as a template and appropriate oligonucleotide primers according to standard PCR amplification techniques. The nucleic acid molecule so amplified can be cloned into an appropriate vector and characterized by DNA sequence analysis. Furthermore, oligonucleotides corresponding to an ACCDP nucleotide sequence can be prepared by standard synthetic techniques, e.g., using an automated DNA synthesizer.

In a preferred embodiment, an isolated nucleic acid molecule according to the invention comprises the nucleotide sequences as set forth in any of sequences shown in Column No. 3 of Table 1 and Table 2. These cDNAs may comprise sequences encoding the ACCDPs, (i.e., the "coding region"), as well as 5' untranslated sequences and 3' untranslated sequences. Alternatively, the nucleic acid molecules according to the present invention can comprise only the coding region of any of the sequences as provided in Column No. 3 of Table 1 and Table 2, or can contain whole genomic fragments isolated from genomic DNA. The present invention also includes ACCDP coding nucleic acids that encode ACCDPs as described herein. Preferred is an ACCDP coding nucleic acid that encodes ACCDP as shown in any of SEQ ID NOS as provided in Column No. 4 of Table 1 and Table 2.

Moreover, the nucleic acid molecule according to the invention can comprise a portion of the coding region of any of the sequences as provided in Column No. 3 of Table 1 and Table 2, for example, a fragment that can be used as a probe or primer or a fragment encoding a biologically active portion of an ACCDP. The nucleotide sequences determined from the cloning of the ACCDP gene from any of the organisms as provided in Table 1 and Table 2 allows for the generation of probes and primers designed for use in identifying and/or cloning ACCDP homologs in other cell types and organisms, as well as ACCDP homologs from crop plants and related species. The portion of the coding region can also encode a biologically active fragment of an ACCDP.

As used herein, the term "biologically active portion of" an ACCDP is intended to include a portion, e.g., a domain/motif, of an ACCDP that participates in modulation of root growth, and/or yield, and/or stress tolerance in a plant, and more preferably, drought tolerance. For the purposes of the present invention, modulation of root growth, and/or yield, and/or stress tolerance refers to at least a 10% increase or decrease in the growth of the roots, and/or yield, and/or stress tolerance of a transgenic plant comprising an ACCDP expression cassette (or expression vector) as compared to the root growth, and/or yield, and/or stress tolerance of a non-transgenic control plant. Methods for quantitating growth, and/or yield, and/or stress tolerance are provided at least in Examples 5, 6, and 17-19 below. In a preferred embodiment, the biologically active portion of an ACCDP increases a plant's root growth, preferably by increasing the root length.

Biologically active portions of an ACCDP include peptides comprising amino acid sequences derived from the amino acid sequence of an ACCDP, e.g., an amino acid sequence of any of SEQ ID NOS as provided in Column No. 4 of Table 1 and Table 2, or the amino acid sequence of a polypeptide identical to an ACCDP, which includes fewer amino acids than a full length ACCDP or the full length polypeptide which is identical to an ACCDP, and exhibits at least one activity of an ACCDP. Typically, biologically active portions (e.g., peptides which are, for example, 5, 10, 15, 20, 30, 35, 36, 37, 38, 39, 40, 50, 100, or more amino acids in length) comprise a domain or motif with at least one activity of an ACCDP. Moreover, other biologically active portions in which other regions of the polypeptide are deleted, can be prepared by recombinant techniques and evaluated for one or more of the activities described herein. Preferably, the biologically active portion of an ACCDP includes one or more selected domains/motifs or portions thereof having function to convert ACC to α-ketobutyrate and ammonia.

The invention also provides ACCDP chimeric or fusion polypeptides. As used herein, an ACCDP "chimeric polypeptide" or "fusion polypeptide" comprises an ACCDP operatively linked to a non-ACCDP. An ACCDP refers to a polypeptide having an amino acid sequence corresponding to an ACCDP, whereas a non-ACCDP refers to a polypeptide having an amino acid sequence corresponding to a polypeptide which is not substantially identical to the ACCDP, e.g., a polypeptide that is different from the ACCDP and is derived from the same or a different organism. With respect to the fusion polypeptide, the term "operatively linked" is intended to indicate that the ACCDP and the non-ACCDP are fused to each other so that both sequences fulfill the proposed function attributed to the sequence used. The non-ACCDP can be fused to the N-terminus or C-terminus of the ACCDP. For example, in one embodiment, the fusion polypeptide is a GST-ACCDP fusion polypeptide in which the ACCDP sequences are fused to the C-terminus of the GST sequences. Such fusion polypeptides can facilitate the purification of recombinant ACCDPs. In another embodiment, the fusion polypeptide is an ACCDP containing a heterologous signal sequence at its N-terminus. In certain host cells (e.g., mammalian host cells), expression and/or secretion of an ACCDP can be increased through use of a heterologous signal sequence.

Preferably, an ACCDP chimeric or fusion polypeptide of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and re-amplified to generate a chimeric gene sequence (See, for example, Current Protocols in Molecular Biology, Eds. Ausubel et al. John Wiley & Sons: 1992). Moreover, many expression vectors are commercially available that already encode a fusion moiety (e.g., a GST polypeptide). An ACCDP encoding nucleic acid can be cloned into such an expression vector such that the fusion moiety is linked in-frame to the ACCDP.

In addition to fragments and fusion polypeptides of the ACCDPs described herein, the present invention includes homologs and analogs of naturally occurring ACCDPs and ACCDP encoding nucleic acids in a plant. "Homologs" are defined herein as two nucleic acids or polypeptides that have similar, or "identical," nucleotide or amino acid sequences, respectively. Homologs include allelic variants, orthologs, paralogs, agonists, and antagonists of ACCDPs as defined hereafter. The term "homolog" further encompasses nucleic acid molecules that differ from the nucleotide sequence as set forth in any of SEQ ID NOS as provided in Column No. 3 of Table 1 and Table 2 (and portions thereof) due to degeneracy of the genetic code and thus encode the same ACCDP as that encoded by the corresponding nucleotide sequence as set forth in such a SEQ ID NO as provided in Column No. 3 of Table 1 and Table 2. As used herein, a "naturally occurring" ACCDP refers to an ACCDP amino acid sequence that occurs in nature. Preferably, a naturally occurring ACCDP comprises an amino acid sequence of any of SEQ ID NOS as provided in Column No. 4 of Table 1 and Table 2.

An agonist of the ACCDP can retain substantially the same, or a subset, of the biological activities of the ACCDP. An antagonist of the ACCDP can inhibit one or more of the activities of the naturally occurring form of the ACCDP.

Nucleic acid molecules corresponding to natural allelic variants and analogs, orthologs, and paralogs of an ACCDP cDNA can be isolated based on their identity to the ACCDP nucleic acids described herein using ACCDP cDNAs, or a portion thereof, as a hybridization probe according to standard hybridization techniques under stringent hybridization conditions. In an alternative embodiment, homologs of the ACCDP can be identified by screening combinatorial libraries of mutants, e.g., truncation mutants, of the ACCDP for ACCDP agonist or antagonist activity. In one embodiment, a variegated library of ACCDP variants is generated by combinatorial mutagenesis at the nucleic acid level and is encoded by a variegated gene library. A variegated library of ACCDP variants can be produced by, for example, enzymatically ligating a mixture of synthetic oligonucleotides into gene sequences such that a degenerate set of potential ACCDP sequences is expressible as individual polypeptides, or alternatively, as a set of larger fusion polypeptides (e.g., for phage display) containing the set of ACCDP sequences therein. There are a variety of methods that can be used to produce libraries of potential ACCDP homologs from a degenerate oligonucleotide sequence. Chemical synthesis of a degenerate gene sequence can be performed in an automatic DNA synthesizer, and the synthetic gene is then ligated into an appropriate expression vector. Use of a degenerate set of genes allows for the provision, in one mixture, of all of the sequences encoding the desired set of potential ACCDP sequences. Methods for synthesizing degenerate oligonucleotides are known in the art.

In addition, libraries of fragments of the ACCDP coding regions can be used to generate a variegated population of ACCDP fragments for screening and subsequent selection of homologs of an ACCDP. In one embodiment, a library of coding sequence fragments can be generated by treating a double stranded PCR fragment of an ACCDP coding sequence with a nuclease under conditions wherein nicking occurs only about once per molecule, denaturing the double stranded DNA, renaturing the DNA to form double stranded DNA, which can include sense/antisense pairs from different nicked products, removing single stranded portions from reformed duplexes by treatment with S1 nuclease, and ligating the resulting fragment library into an expression vector. By this method, an expression library can be derived which encodes N-terminal, C-terminal, and internal fragments of various sizes of the ACCDP.

Several techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of ACCDP homologs. The most widely used techniques, which are amenable to high throughput analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a technique that enhances the frequency of functional mutants in the libraries, can be used in combination with the screening assays to identify ACCDP homologs (Arkin and Yourvan, 1992, PNAS 89:7811-7815; Delgrave et al., 1993, Polypeptide Engineering 6(3):327-331). In another embodiment, cell based assays can be exploited to analyze a variegated ACCDP library, using methods well known in the art. The present invention further provides a method of identifying a novel ACCDP, comprising (a) raising a specific antibody response to an ACCDP, or a fragment thereof, as described herein; (b) screening putative ACCDP material with the antibody, wherein specific binding of the antibody to the material indicates the presence of a potentially novel ACCDP; and (c) analyzing the bound material in comparison to known ACCDP, to determine its novelty.

As stated above, the present invention relates to ACCDPs and homologs thereof. To determine the percent sequence identity of two amino acid sequences (e.g., the sequence of any of SEQ ID NOS as provided in Column No. 4 of Table 1 and Table 2, and a mutant form thereof), the sequences are aligned for optimal comparison purposes (e.g., gaps can be introduced in the sequence of one polypeptide for optimal alignment with the other polypeptide or nucleic acid). The amino acid residues at corresponding amino acid positions are then compared. When a position in one sequence (e.g., the sequence of any of SEQ ID NOS as provided in Column No. 4 of Table 1 and Table 2) is occupied by the same amino acid residue as the corresponding position in the other sequence (e.g., the sequence of a mutant form of the corresponding SEQ ID NO as provided in Column No. 4 of Table 1 and Table 2), then the molecules are identical at that position. The same type of comparison can be made between two nucleic acid sequences.

The percent sequence identity between the two sequences is a function of the number of identical positions shared by the sequences (i.e., percent sequence identity=numbers of identical positions/total numbers of positions×100). Preferably, the isolated amino acid homologs included in the present invention are at least about 50-60%, preferably at least about 60-70%, and more preferably at least about 70-75%, 75-80%, 80-85%, 85-90%, or 90-95%, and most preferably at least about 96%, 97%, 98%, 99%, or more identical to an entire amino acid sequence shown in any of SEQ ID NOS as provided in Column No. 4 of Table 1 and Table 2. In yet another embodiment, the isolated amino acid homologs included in the present invention are at least about 50-60%, preferably at least about 60-70%, and more preferably at least about 70-75%, 75-80%, 80-85%, 85-90%, or 90-95%, and most preferably at least about 96%, 97%, 98%, 99%, or more identical to an entire amino acid sequence encoded by a nucleic acid sequence shown in any of SEQ ID NOS as provided in Column No. 3 of Table 1 and Table 2.

In another preferred embodiment, an isolated nucleic acid homolog of the invention comprises a nucleotide sequence which is at least about 40-60%, preferably at least about 60-70%, more preferably at least about 70-75%, 75-80%, 80-85%, 85-90%, or 90-95%, and even more preferably at least about 95%, 96%, 97%, 98%, 99%, or more identical to a nucleotide sequence shown in any of SEQ ID NOS as provided in Column No. 3 of Table 1 and Table 2, or to a portion comprising at least 60 consecutive nucleotides thereof. The preferable length of sequence comparison for nucleic acids is at least 75 nucleotides, more preferably at least 100 nucleotides, and most preferably the entire length of the coding region. It is even more preferable that the nucleic acid homologs encode proteins having homology with any of SEQ ID NOS as provided in Column No. 4 of Table 1 and Table 2.

It is further preferred that the isolated nucleic acid homolog of the invention encodes an ACCDP, or portion thereof, that is at least 80% identical to an amino acid sequence of any of SEQ ID NOS as provided in Column No. 4 of Table 1 and Table 2, and that functions as a modulator of root growth, and/or yield, and/or an environmental stress response in a plant. In a more preferred embodiment, overexpression of the nucleic acid homolog in a plant increases the plant's root growth, and/or yield, and/or the tolerance of the plant to an environmental stress. In a further preferred embodiment, the nucleic acid homolog encodes an ACCDP that can convert ACC to α-ketobutyrate and ammonia.

For the purposes of the invention, the percent sequence identity between two nucleic acid or polypeptide sequences is determined using the Vector NTI 9.0 (PC) software package (Invitrogen, 1600 Faraday Ave., Carlsbad, Calif. 92008). A gap opening penalty of 15 and a gap extension penalty of 6.66 are used for determining the percent identity of two nucleic acids. A gap opening penalty of 10 and a gap extension penalty of 0.1 are used for determining the percent identity of two polypeptides. All other parameters are set at the default settings. For purposes of a multiple alignment (Clustal W algorithm), the gap opening penalty is 10, and the gap extension penalty is 0.05 with blosum62 matrix. It is to be understood that for the purposes of determining sequence identity when comparing a DNA sequence to an RNA sequence, a thymidine nucleotide is equivalent to a uracil nucleotide.

In another aspect, the invention relates to an isolated nucleic acid comprising a polynucleotide that hybridizes to the polynucleotide of any of SEQ ID NOS as provided in Column No. 3 of Table 1 and Table 2 under stringent conditions. More particularly, an isolated nucleic acid molecule according to the invention is at least 15 nucleotides in length and hybridizes under stringent conditions to the nucleic acid molecule comprising a nucleotide sequence of any of SEQ ID NOS as provided in Column No. 3 of Table 1 and Table 2. In other embodiments, the nucleic acid is at least 30, 50, 100, 250, or more nucleotides in length. Preferably, an isolated nucleic acid homolog of the invention comprises a nucleotide sequence which hybridizes under highly stringent conditions to the nucleotide sequence shown in any of SEQ ID NOS as provided in Column No. 3 of Table 1 and Table 2 and functions as a modulator of root growth, and/or yield, and/or stress tolerance in a plant. In a further preferred embodiment, overexpression of the isolated nucleic acid homolog in a plant increases a plant's root growth, and/or yield, and/or tolerance to an environmental stress. In an even further preferred embodiment, the isolated nucleic acid homolog encodes an ACCDP that can convert ACC to α-ketobutyrate and ammonia.

As used herein with regard to hybridization for DNA to a DNA blot, the term "stringent conditions" may refer to hybridization overnight at 60° C. in 10× Denhart's solution, 6×SSC, 0.5% SDS, and 100 µg/ml denatured salmon sperm DNA. Blots are washed sequentially at 62° C. for 30 minutes each time in 3×SSC/0.1% SDS, followed by 1×SSC/0.1% SDS, and finally 0.1×SSC/0.1% SDS. In a preferred embodiment, the phrase "stringent conditions" refers to hybridization in a 6×SSC solution at 65° C. As also used herein, "highly stringent conditions" refers to hybridization overnight at 65° C. in 10× Denharts solution, 6×SSC, 0.5% SDS, and 100 µg/ml denatured salmon sperm DNA. Blots are washed sequentially at 65° C. for 30 minutes each time in 3×SSC/0.1% SDS, followed by 1×SSC/0.1% SDS, and finally 0.1× SSC/0.1% SDS. Methods for nucleic acid hybridizations are described in Meinkoth and Wahl, 1984, Anal. Biochem. 138: 267-284; Current Protocols in Molecular Biology, Chapter 2, Ausubel et al. Eds., Greene Publishing and Wiley-Interscience, New York, 1995; and Tijssen, 1993, Laboratory Techniques in Biochemistry and Molecular Biology Hybridization with Nucleic Acid Probes, Part I, Chapter 2, Elsevier, N.Y., 1993. Preferably, an isolated nucleic acid molecule of the invention that hybridizes under stringent or highly stringent conditions to a sequence of any of SEQ ID NOS as provided in Column No. 3 of Table 1 and Table 2 corresponds to a naturally occurring nucleic acid molecule. As used herein, a "naturally occurring" nucleic acid molecule refers to an RNA or DNA molecule having a nucleotide sequence that occurs in nature (e.g., encodes a natural polypeptide). In one embodiment, the nucleic acid encodes a naturally occurring ACCDP.

Using the above-described methods, and others known to those of skill in the art, one of ordinary skill in the art can isolate homologs of the ACCDPs comprising amino acid sequences shown in any of SEQ ID NOS as provided in Column No. 4 of Table 1 and Table 2. One subset of these homologs is allelic variants. As used herein, the term "allelic variant" refers to a nucleotide sequence containing polymorphisms that lead to changes in the amino acid sequences of an ACCDP and that exist within a natural population (e.g., a plant species or variety). Such natural allelic variations can typically result in 1-5% variance in an ACCDP nucleic acid. Allelic variants can be identified by sequencing the nucleic acid sequence of interest in a number of different plants, which can be readily carried out by using hybridization probes to identify the same ACCDP genetic locus in those plants. Any and all such nucleic acid variations and resulting amino acid polymorphisms or variations in an ACCDP that are the result of natural allelic variation and that do not alter the functional activity of an ACCDP, are intended to be within the scope of the invention.

Moreover, nucleic acid molecules encoding ACCDPs from the same or other species such as ACCDP analogs, orthologs, and paralogs, are intended to be within the scope of the present invention. As used herein, the term "analogs" refers to two nucleic acids that have the same or similar function, but that have evolved separately in unrelated organisms. As used herein, the term "orthologs" refers to two nucleic acids from different species, but that have evolved from a common ancestral gene by speciation. Normally, orthologs encode polypeptides having the same or similar functions. As also used herein, the term "paralogs" refers to two nucleic acids that are related by duplication within a genome. Paralogs usually have different functions, but these functions may be related (Tatusov, R. L. et al., 1997, Science 278(5338):631-637). Analogs; orthologs, and paralogs of a naturally occurring ACCDP can differ from the naturally occurring ACCDP by post-translational modifications, by amino acid sequence differences, or by both. Post-translational modifications include in vivo and in vitro chemical derivatization of polypeptides, e.g., acetylation, carboxylation, phosphorylation, or glycosylation, and such modifications may occur during polypeptide synthesis or processing or following treatment with isolated modifying enzymes. In particular, orthologs of the invention will generally exhibit at least 80-85%, more preferably, 85-90% or 90-95%, and most preferably 95%, 96%, 97%, 98%, or even 99% identity, or 100% sequence identity, with all or part of a naturally occurring ACCDP amino acid sequence, and will exhibit a function similar to an ACCDP. Preferably, an ACCDP ortholog of the present invention functions as a modulator of growth and/or an environmental stress response in a plant and/or converts ACC to α-ketobutyrate and ammonia. More preferably, an ACCDP ortholog increases the growth and/or stress tolerance of a plant. In one embodiment, the ACCDP orthologs can convert ACC to α-ketobutyrate and ammonia.

In addition to naturally-occurring variants of an ACCDP sequence that may exist in the population, the skilled artisan will further appreciate that changes can be introduced by mutation into a nucleotide sequence of any of SEQ ID NOS as provided in Column No. 4 of Table 1 and Table 2, thereby leading to changes in the amino acid sequence of the encoded ACCDP, without altering the functional activity of the ACCDP. For example, nucleotide substitutions leading to amino acid substitutions at "non-essential" amino acid residues can be made in a sequence of any of SEQ ID NOS as provided in Column No. 3 of Table 1 and Table 2. A "non-essential" amino acid residue is a residue that can be altered from the wild-type sequence of one of the ACCDPs without altering the activity of said ACCDP, whereas an "essential" amino acid residue is required for ACCDP activity. Other amino acid residues, however, (e.g., those that are not conserved or only semi-conserved in the domain having ACCDP activity) may not be essential for activity and thus are likely to be amenable to alteration without altering ACCDP activity.

Accordingly, another aspect of the invention pertains to nucleic acid molecules encoding ACCDPs that contain changes in amino acid residues that are not essential for ACCDP activity. Such ACCDPs differ in amino acid sequence from a sequence contained in any of SEQ ID NOS as provided in Column No. 4 of Table 1 and Table 2, yet retain at least one of the ACCDP activities described herein. In one embodiment, the isolated nucleic acid molecule comprises a nucleotide sequence encoding a polypeptide, wherein the polypeptide comprises an amino acid sequence at least about 50-60% identical to the sequence of any of SEQ ID NOS as provided in Column No. 4 of Table 1 and Table 2, more preferably at least about 60-70% identical to the sequence of any of SEQ ID NOS as provided in Column No. 4 of Table 1 and Table 2, even more preferably at least about 70-75%, 75-80%, 80-85%, 85-90%, or 90-95% identical to the sequence of any of SEQ ID NOS as provided in Column No. 4 of Table 1 and Table 2, and most preferably at least about 96%, 97%, 98%, or 99% identical to the sequence of any of SEQ ID NOS as provided in Column No. 4 of Table 1 and Table 2. The preferred ACCDP homologs of the present invention preferably participate in a plant's root growth, and/or yield, and/or a stress tolerance response in a plant, or more particularly, can convert ACC to α-ketobutyrate and ammonia.

An isolated nucleic acid molecule encoding an ACCDP having sequence identity with a polypeptide sequence of any of SEQ ID NOS as provided in Column No. 4 of Table 1 and Table 2 can be created by introducing one or more nucleotide substitutions, additions, or deletions into a nucleotide sequence of any of SEQ ID NOS as provided in Column No. 3 of Table 1 and Table 2, such that one or more amino acid substitutions, additions, or deletions are introduced into the encoded polypeptide. Mutations can be introduced into the sequence of any of SEQ ID NOS as provided in Column No. 3 of Table 1 and Table 2 by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain.

Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine), and aromatic side chains (e.g., tyrosine, phenylalanine, tryptophan, histidine). Thus, a predicted nonessential amino acid residue in an ACCDP is preferably replaced with another amino acid residue from the same side chain family. Alternatively, in another embodiment, mutations can be introduced randomly along all or part of an ACCDP coding sequence, such as by saturation mutagenesis, and the resultant mutants can be screened for an ACCDP activity described herein to identify mutants that retain ACCDP activity. Following mutagenesis of the sequence of any of SEQ ID NOS as provided in Column No. 3 of Table 1 and Table 2 the encoded polypeptide can be expressed recombinantly and the activity of the polypeptide can be determined by analyzing the root growth, and/or yield, and/or stress tolerance of a plant expressing the polypeptide as described at least in Examples 5, 6, and 17-19.

Additionally, optimized ACCDP nucleic acids can be created. Preferably, an optimized ACCDP nucleic acid encodes an ACCDP that modulates a plant's root growth, and/or yield, and/or tolerance to an environmental stress, and more preferably increases a plant's root growth, and/or yield, and/or tolerance to an environmental stress upon its overexpression in the plant. As used herein, "optimized" refers to a nucleic acid that is genetically engineered to increase its expression in a given plant or animal. To provide plant optimized ACCDP nucleic acids, the DNA sequence of the gene can be modified to 1) comprise codons preferred by highly expressed plant genes; 2) comprise an A+T content in nucleotide base composition to that substantially found in plants; 3) form a plant initiation sequence; or 4) to eliminate sequences that cause destabilization, inappropriate polyadenylation, degradation and termination of RNA, or that form secondary structure hairpins or RNA splice sites. Increased expression of ACCDP nucleic acids in plants can be achieved by utilizing the distribution frequency of codon usage in plants in general or in a particular plant. Methods for optimizing nucleic acid expression in plants can be found in EPA 0359472; EPA 0385962; PCT Application No. WO 91/16432; U.S. Pat. No. 5,380,831; U.S. Pat. No. 5,436,391; Perlack et al., 1991, Proc. Natl. Acad. Sci. USA 88:3324-3328; and Murray et al., 1989, Nucleic Acids Res. 17:477-498.

As used herein, "frequency of preferred codon usage" refers to the preference exhibited by a specific host cell in usage of nucleotide codons to specify a given amino acid. To determine the frequency of usage of a particular codon in a gene, the number of occurrences of that codon in the gene is divided by the total number of occurrences of all codons specifying the same amino acid in the gene. Similarly, the frequency of preferred codon usage exhibited by a host cell can be calculated by averaging frequency of preferred codon usage in a large number of genes expressed by the host cell. It is preferable that this analysis be limited to genes that are highly expressed by the host cell. The percent deviation of the frequency of preferred codon usage for a synthetic gene from that employed by a host cell is calculated first by determining the percent deviation of the frequency of usage of a single codon from that of the host cell followed by obtaining the average deviation over all codons. As defined herein, this calculation includes unique codons (i.e., ATG and TGG). In general terms, the overall average deviation of the codon usage of an optimized gene from that of a host cell is calculated using the equation $1A = n = 1\ Z\ X_n - Y_n X_n$ times $100\ Z$ where $X_n$=frequency of usage for codon n in the host cell; $Y_n$=frequency of usage for codon n in the synthetic gene; n represents an individual codon that specifies an amino acid; and the total number of codons is Z. The overall deviation of the frequency of codon usage, A, for all amino acids should preferably be less than about 25%, and more preferably less than about 10%.

Hence, an ACCDP nucleic acid can be optimized such that its distribution frequency of codon usage deviates, preferably, no more than 25% from that of highly expressed plant genes and, more preferably, no more than about 10%. In addition, consideration is given to the percentage G+C content of the degenerate third base (monocotyledons appear to favor G+C in this position, whereas dicotyledons do not). It is also recognized that the XCG (where X is A, T, C, or G) nucleotide is the least preferred codon in dicots whereas the XTA codon is avoided in both monocots and dicots. Optimized ACCDP nucleic acids of this invention also preferably have CG and TA doublet avoidance indices closely approximating those of the chosen host plant (e.g., *Arabidopsis thaliana, Oryza sativa*, etc.). More preferably these indices deviate from that of the host by no more than about 10-15%.

In addition to the nucleic acid molecules encoding the ACCDPs described above, another aspect of the invention pertains to isolated nucleic acid molecules that are antisense thereto. Antisense polynucleotides are thought to inhibit gene expression of a target polynucleotide by specifically binding the target polynucleotide and interfering with transcription, splicing, transport, translation, and/or stability of the target-polynucleotide. Methods are described in the prior art for targeting the antisense polynucleotide to the chromosomal DNA, to a primary RNA transcript, or to a processed mRNA. Preferably, the target regions include splice sites, translation initiation codons, translation termination codons, and other sequences within the open reading frame.

The term "antisense," for the purposes of the invention, refers to a nucleic acid comprising a polynucleotide that is sufficiently complementary to all or a portion of a gene, primary transcript, or processed mRNA, so as to interfere with expression of the endogenous gene. "Complementary" polynucleotides are those that are capable of base pairing according to the standard Watson-Crick complementarity rules. Specifically, purines will base pair with pyrimidines to form a combination of guanine paired with cytosine (G:C) and adenine paired with either thymine (A:T) in the case of DNA, or adenine paired with uracil (A:U) in the case of RNA. It is understood that two polynucleotides may hybridize to each other even if they are not completely complementary to each other, provided that each has at least one region that is substantially complementary to the other. The term "antisense nucleic acid" includes single stranded RNA as well as double-stranded DNA expression cassettes that can be transcribed to produce an antisense RNA. "Active" antisense nucleic acids are antisense RNA molecules that are capable of selectively hybridizing with a primary transcript or mRNA encoding a polypeptide having at least 80% sequence identity with the polypeptide of any of SEQ ID NOS as provided in Column No. 4 of Table 1 and Table 2.

The antisense nucleic acid can be complementary to an entire ACCDP coding strand, or to only a portion thereof. In one embodiment, an antisense nucleic acid molecule is antisense to a "coding region" of the coding strand of a nucleotide sequence encoding an ACCDP. The term "coding region" refers to the region of the nucleotide sequence comprising codons that are translated into amino acid residues. In another embodiment, the antisense nucleic acid molecule is antisense to a "noncoding region" of the coding strand of a nucleotide sequence encoding an ACCDP. The term "noncoding region" refers to 5' and 3' sequences that flank the coding region that are not translated into amino acids (i.e., also referred to as 5' and 3' untranslated regions). The antisense nucleic acid molecule can be complementary to the entire coding region of ACCDP mRNA, but more preferably is an oligonucleotide that is antisense to only a portion of the coding or noncoding region of ACCDP mRNA. For example, the antisense oligonucleotide can be complementary to the region surrounding the translation start site of ACCDP mRNA. An antisense oligonucleotide can be, for example, about 5, 10, 15, 20, 25, 30, 35, 40, 45, or 50 nucleotides in length. Typically, the antisense molecules of the present invention comprise an RNA having 60-100% sequence identity with at least 14 consecutive nucleotides of any of SEQ ID NOS as provided in Column No. 3 of Table 1 and Table 2 or a polynucleotide encoding a polypeptide of any of SEQ ID NOS as provided in Column No. 4 of Table 1 and Table 2. Preferably, the sequence identity will be at least 70%, more preferably at least 75%, 80%, 85%, 90%, 95%, or 98%, and most preferably 99%.

An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosyl queosine, 5'-methoxycarboxymethyluracil, 5-methoxyuracil, 2-methylthio-N-6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual β-units, the strands run parallel to each other (Gaultier et al., 1987, Nucleic Acids. Res. 15:6625-6641). The antisense nucleic acid molecule can also comprise a 2'-O-methylribonucleotide (Inoue et al., 1987, Nucleic Acids Res. 15:6131-6148) or a chimeric RNA-DNA analogue (Inoue et al., 1987, FEBS Lett. 215:327-330).

The antisense nucleic acid molecules of the invention are typically administered to a cell or generated in situ such that they hybridize with or bind to cellular mRNA and/or genomic DNA encoding an ACCDP to thereby inhibit expression of the polypeptide, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. The antisense molecule can be modified such that it specifically binds to a receptor or an antigen expressed on a selected cell surface, e.g., by linking the antisense nucleic acid molecule to a peptide or an antibody which binds to a cell surface receptor or antigen. The antisense nucleic acid molecule can also be delivered to cells using the vectors described herein. To achieve sufficient intracellular concentrations of the antisense molecules, vector constructs in which the antisense nucleic acid molecule is placed under the control of a strong prokaryotic, viral, or eukaryotic (including plant) promoter are preferred.

As an alternative to antisense polynucleotides, ribozymes, sense polynucleotides, or double stranded RNA (dsRNA) can be used to reduce expression of an ACCDP polypeptide. As used herein, the term "ribozyme" refers to a catalytic RNA-based enzyme with ribonuclease activity that is capable of cleaving a single-stranded nucleic acid, such as an mRNA, to which it has a complementary region. Ribozymes (e.g., hammerhead ribozymes described in Haselhoff and Gerlach, 1988, Nature 334:585-591) can be used to catalytically cleave ACCDP mRNA transcripts to thereby inhibit translation of ACCDP mRNA. A ribozyme having specificity for an ACCDP-encoding nucleic acid can be designed based upon the nucleotide sequence of an ACCDP cDNA, as disclosed herein (i.e., any of SEQ ID NOS as provided in Column No. 3 of Table 1 and Table 2) or on the basis of a heterologous sequence to be isolated according to methods taught in this invention. For example, a derivative of a *Tetrahymena* L-19 IVS RNA can be constructed in which the nucleotide sequence of the active site is complementary to the nucleotide sequence to be cleaved in an ACCDP-encoding mRNA. See, e.g., U.S. Pat. Nos. 4,987,071 and 5,116,742 to Cech et al. Alternatively, ACCDP mRNA can be used to select a catalytic RNA having a specific ribonuclease activity from a pool of RNA molecules. See, e.g., Bartel, D. and Szostak, J. W., 1993, Science 261:1411-1418. In preferred embodiments, the ribozyme will contain a portion having at least 7, 8, 9, 10, 12, 14, 16, 18, or 20 nucleotides, and more preferably 7 or 8 nucleotides, that have 100% complementarity to a portion of the target RNA. Methods for making ribozymes are known to those skilled in the art. See, e.g., U.S. Pat. Nos. 6,025,167; 5,773,260; and 5,496,698.

The term "dsRNA," as used herein, refers to RNA hybrids comprising two strands of RNA. The dsRNAs can be linear or circular in structure. In a preferred embodiment, dsRNA is specific for a polynucleotide encoding either the polypeptide of any of SEQ ID NOS as provided in Column No. 4 of Table 1 and Table 2 or a polypeptide having at least 80% sequence identity with a polypeptide of any of SEQ ID NOS as provided in Column No. 4 of Table 1 and Table 2. The hybridizing RNAs may be substantially or completely complementary. By "substantially complementary," is meant that when the two hybridizing RNAs are optimally aligned using the BLAST program as described above, the hybridizing portions are at least 95% complementary. Preferably, the dsRNA will be at least 100 base pairs in length. Typically, the hybridizing RNAs will be of identical length with no over hanging 5' or 3' ends and no gaps. However, dsRNAs having 5' or 3' overhangs of up to 100 nucleotides may be used in the methods of the invention.

The dsRNA may comprise ribonucleotides, ribonucleotide analogs such as 2'-O-methyl ribosyl residues, or combinations thereof. See, e.g., U.S. Pat. Nos. 4,130,641 and 4,024,222. A dsRNA polyriboinosinic acid:polyribocytidylic acid is described in U.S. Pat. No. 4,283,393. Methods for making and using dsRNA are known in the art. One method comprises the simultaneous transcription of two complementary DNA strands, either in vivo, or in a single in vitro reaction mixture. See, e.g., U.S. Pat. No. 5,795,715. In one embodiment, dsRNA can be introduced into a plant or plant cell directly by standard transformation procedures. Alternatively, dsRNA can be expressed in a plant cell by transcribing two complementary RNAs.

Other methods for the inhibition of endogenous gene expression, such as triple helix formation (Moser et al., 1987, Science 238:645-650 and Cooney et al., 1988, Science 241:456-459) and co-suppression (Napoli et al., 1990, The Plant Cell 2:279-289) are known in the art. Partial and full-length cDNAs have been used for the cosuppression of endogenous plant genes. See, e.g., U.S. Pat. Nos. 4,801,340, 5,034,323, 5,231,020, and 5,283,184; Van der Kroll et al., 1990, The Plant Cell 2:291-299; Smith et al., 1990, Mol. Gen. Genetics 224:477-481; and Napoli et al., 1990, The Plant Cell 2:279-289.

For sense suppression, it is believed that introduction of a sense polynucleotide blocks transcription of the corresponding target gene. The sense polynucleotide will have at least 65% sequence identity with the target plant gene or RNA. Preferably, the percent identity is at least 80%, 90%, 95%, or more. The introduced sense polynucleotide need not be full length relative to the target gene or transcript. Preferably, the sense polynucleotide will have at least 65% sequence identity with at least 100 consecutive nucleotides of any of SEQ ID NOS as provided in Column No. 3 of Table 1 and Table 2. The regions of identity can comprise introns and/or exons and untranslated regions. The introduced sense polynucleotide may be present in the plant cell transiently, or may be stably integrated into a plant chromosome or extrachromosomal replicon.

Alternatively, ACCDP gene expression can be inhibited by targeting nucleotide sequences complementary to the regulatory region of an ACCDP nucleotide sequence (e.g., an ACCDP promoter and/or enhancer) to form triple helical structures that prevent transcription of an ACCDP gene in target cells. See generally, Helene, C., 1991, Anticancer Drug Des. 6(6):569-84; Helene, C. et al., 1992, Ann. N.Y. Acad. Sci. 660:27-36; and Maher, L. J., 1992, Bioassays 14(12):807-15.

In addition to the ACCDP nucleic acids and polypeptides described above, the present invention encompasses these nucleic acids and polypeptides attached to a moiety. These moieties include, but are not limited to, detection moieties, hybridization moieties, purification moieties, delivery moieties, reaction moieties, binding moieties, and the like. A typical group of nucleic acids having moieties attached are probes and primers. Probes and primers typically comprise a substantially isolated oligonucleotide. The oligonucleotide typically comprises a region of nucleotide sequence that hybridizes under stringent conditions to at least about 12, preferably about 25, more preferably about 40, 50, or 75 consecutive nucleotides of a sense strand of the sequence set forth in any of SEQ ID NOS as provided in Column No. 3 of Table 1 and Table 2; an anti-sense sequence of the sequence set forth in any of SEQ ID NOS as provided in Column No: 3 of Table 1 and Table 2; or naturally occurring mutants thereof. Primers based on a nucleotide sequence of any of SEQ ID NOS as provided in Column No. 3 of Table 1 and Table 2 can be used in PCR reactions to clone ACCDP homologs. Probes based on the ACCDP nucleotide sequences can be used to detect transcripts or genomic sequences encoding the same or substantially identical polypeptides. In preferred embodiments, the probe further comprises a label group attached thereto, e.g. the label group can be a radioisotope, a fluorescent compound, an enzyme, or an enzyme co-factor. Such probes can be used as a part of a genomic marker test kit for identifying cells which express an ACCDP, such as by measuring a level of an ACCDP-encoding nucleic acid, in a sample of cells, e.g., detecting ACCDP mRNA levels or determining whether a genomic ACCDP gene has been mutated or deleted.

In particular, a useful method to ascertain the level of transcription of the gene (an indicator of the amount of mRNA available for translation to the gene product) is to perform a Northern blot (For reference, see, for example, Ausubel et al., 1988, Current Protocols in Molecular Biology, Wiley: New York). The information from a Northern blot at least partially demonstrates the degree of transcription of the transformed gene. Total cellular RNA can be prepared from cells, tissues, or organs by several methods, all well-known in the art, such as that described in Bormann, E. R. et al., 1992, Mol. Microbiol. 6:317-326. To assess the presence or relative quantity of polypeptide translated from this mRNA, standard techniques, such as a Western blot, may be employed. These techniques are well known to one of ordinary skill in the art. (See, for example, Ausubel et al., 1988, Current Protocols in Molecular Biology, Wiley: New York).

The invention further provides an isolated recombinant expression vector comprising an ACCDP nucleic acid, wherein expression of the vector in a host cell results in increased root growth, and/or yield, and/or tolerance to environmental stress as compared to a wild type variety of the host cell. As used herein, the term "vector" refers to a nucleic acid molecule capable of transporting another nucleic acid to which it has been linked. One type of vector is a "plasmid," which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors." In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses, and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which is operatively linked to the nucleic acid sequence to be expressed. As used herein with respect to a recombinant expression vector, "operatively linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers, and other expression control elements (e.g., polyadenylation signals). Such regulatory sequences are described, for example, in Goeddel, Gene Expression Technology Methods in Enzymology 185, Academic Press, San Diego, Calif. (1990) and Gruber and Crosby, in: Methods in Plant Molecular Biology and Biotechnology, eds. Glick and Thompson, Chapter 7, 89-108, CRC Press: Boca Raton, Fla., including the references therein. Regulatory sequences include those that direct constitutive expression of a nucleotide sequence in many types of host cells and those that direct expression of the nucleotide sequence only in certain host cells or under certain conditions. It will be appreciated by those skilled in the art that the design of the expression vector can depend on such factors as the choice of the host cell to be transformed, the level of expression of polypeptide desired, etc. The expression vectors of the invention can be introduced into host cells to thereby produce polypeptides or peptides, including fusion polypeptides or peptides, encoded by nucleic acids as described herein (e.g., ACCDPs, mutant forms of ACCDPs, fusion polypeptides, etc.).

The recombinant expression vectors of the invention can be designed for expression of ACCDPs in prokaryotic or eukaryotic cells. For example, ACCDP genes can be expressed in bacterial cells such as *C. glutamicum*, insect cells (using baculovirus expression vectors), yeast and other fungal cells (See Romanos, M. A. et al., 1992, Foreign gene expression in yeast: a review, Yeast 8:423-488; van den Hondel, C. A. M. J. J. et al., 1991, Heterologous gene expression in filamentous fungi, in: More Gene Manipulations in Fungi, J. W. Bennet & L. L. Lasure, eds., p. 396-428: Academic Press: San Diego; and van den Hondel, C. A. M. J. J. & Punt, P. J., 1991, Gene transfer systems and vector development for filamentous fungi, in: Applied Molecular Genetics of Fungi, Peberdy, J. F. et al., eds., p. 1-28, Cambridge University Press: Cambridge), algae (Falciatore et al., 1999, Marine Biotechnology 1(3): 239-251), ciliates of the types: *Holotrichia, Peritrichia, Spirotrichia, Suctoria, Tetrahymena, Paramecium, Colpidium, Glaucoma, Platyophrya, Potomacus, Pseudocohnilembus, Euplotes, Engelmaniella*, and *Stylonychia*, especially of the genus *Stylonychia lemnae* with vectors following a transformation method as described in PCT Application No. WO 98/01572, and multicellular plant cells (See Schmidt, R. and Willmitzer, L., 1988, High efficiency *Agrobacterium tumefaciens*-mediated transformation of *Arabidopsis thaliana* leaf and cotyledon explants, Plant Cell Rep. 583-586; Plant Molecular Biology and Biotechnology, C Press, Boca Raton, Fla., chapter 6/7, S.71-119 (1993); F. F. White, B. Jenes et al., Techniques for Gene Transfer, in: Transgenic Plants, Vol. 1, Engineering and Utilization, eds. Kung and R. Wu, 128-43, Academic Press: 1993; Pottykus, 1991, Annu. Rev. Plant Physiol. Plant Molec. Biol. 42:205-225 and references cited therein), or mammalian cells. Suitable host cells are discussed further in Goeddel, Gene Expression Technology Methods in Enzymology 185, Academic Press: San Diego, Calif. (1990). Alternatively, the recombinant expression vector can be transcribed and translated in vitro, for example using T7 promoter regulatory sequences and T7 polymerase.

Expression of polypeptides in prokaryotes is most often carried out with vectors containing constitutive or inducible promoters directing the expression of either fusion or non-fusion polypeptides. Fusion vectors add a number of amino acids to a polypeptide encoded therein, usually to the amino terminus of the recombinant polypeptide but also to the C-terminus or fused within suitable regions in the polypeptides. Such fusion vectors typically serve three purposes: 1) to increase expression of a recombinant polypeptide; 2) to increase the solubility of a recombinant polypeptide; and 3) to aid in the purification of a recombinant polypeptide by acting as a ligand in affinity purification. Often, in fusion expression vectors, a proteolytic cleavage site is introduced at the junction of the fusion moiety and the recombinant polypeptide to enable separation of the recombinant polypeptide from the fusion moiety subsequent to purification of the fusion polypeptide. Such enzymes, and their cognate recognition sequences, include Factor Xa, thrombin, and enterokinase.

Typical fusion expression vectors include pGEX (Pharmacia Biotech Inc; Smith, D. B. and Johnson, K. S., 1988, Gene 67:31-40), pMAL (New England Biolabs, Beverly, Mass.), and pRIT5 (Pharmacia, Piscataway, N.J.) which fuse glutathione S-transferase (GST), maltose E binding polypeptide, or polypeptide A, respectively, to the target recombinant polypeptide. In one embodiment, the coding sequence of the ACCDP is cloned into a pGEX expression vector to create a vector encoding a fusion polypeptide comprising, from the N-terminus to the C-terminus, GST-thrombin cleavage site-X polypeptide. The fusion polypeptide can be purified by affinity chromatography using glutathione-agarose resin. Recombinant ACCDP unfused to GST can be recovered by cleavage of the fusion polypeptide with thrombin.

Examples of suitable inducible non-fusion *E. coli* expression vectors include pTrc (Amann et al., 1988, Gene 69:301-315) and pET 11d (Studier et al., Gene Expression Technology: Methods in Enzymology 185, Academic Press, San Diego, Calif. (1990) 60-89). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a co-expressed viral RNA polymerase (T7 gn1). This viral polymerase is supplied by host strains BL21(DE3) or HMS174(DE3) from a resident prophage harboring a T7 gn1 gene under the transcriptional control of the lacUV 5 promoter.

One strategy to maximize recombinant polypeptide expression is to express the polypeptide in a host bacterium with an impaired capacity to proteolytically cleave the recombinant polypeptide (Gottesman, S., Gene Expression Technology: Methods in Enzymology 185, Academic Press, San Diego, Calif. (1990) 119-128). Another strategy is to alter the sequence of the nucleic acid to be inserted into an expression vector so that the individual codons for each amino acid are those preferentially utilized in the bacterium chosen for expression, such as *C. glutamicum* (Wada et al., 1992, Nucleic Acids Res. 20:2111-2118). Such alteration of nucleic acid sequences of the invention can be carried out by standard DNA synthesis techniques.

In another embodiment, the ACCDP expression vector is a yeast expression vector. Examples of vectors for expression in yeast *S. cerevisiae* include pYepSec1 (Baldari, et al., 1987, EMBO J. 6:229-234), pMFa (Kurjan and Herskowitz, 1982, Cell 30:933-943), pJRY88 (Schultz et al., 1987, Gene 54:113-123), and pYES2 (Invitrogen Corporation, San Diego, Calif.). Vectors and methods for the construction of vectors appropriate for use in other fungi, such as the filamentous fungi, include those detailed in: van den Hondel, C. A. M. J. J. & Punt, P. J., 1991, "Gene transfer systems and vector development for filamentous fungi," in: Applied Molecular Genetics of Fungi, J. F. Peberdy, et al., eds., p. 1-28, Cambridge University Press: Cambridge.

In a preferred embodiment of the present invention, the ACCDPs are expressed in plants and plants cells such as unicellular plant cells (e.g. algae) (See Falciatore et al., 1999, Marine Biotechnology 1(3):239-251 and references therein) and plant cells from higher plants (e.g., the spermatophytes, such as crop plants). AN ACCDP may be "introduced" into a plant cell by any means, including transfection, transformation or transduction, electroporation, particle bombardment, agroinfection, and the like. One transformation method known to those of skill in the art is the dipping of a flowering plant into an *Agrobacteria* solution, wherein the *Agrobacteria* contain the ACCDP nucleic acid, followed by breeding of the transformed gametes.

Other suitable methods for transforming or transfecting host cells including plant cells can be found in Sambrook, et al. (Molecular Cloning: A Laboratory Manual. latest ed., Cold Spring Harbor Laboratory, Cold Spring Harbor Laboratory Press, Cold Spring Harbor, N.Y., 1989) and other laboratory manuals such as Methods in Molecular Biology, 1995, Vol. 44, *Agrobacterium* protocols, ed: Gartland and Davey, Humana Press, Totowa, N.J. As increased growth and increased biotic and abiotic stress tolerance are general traits wished to be inherited into a wide variety of plants like maize, wheat, rye, oat, triticale, rice, barley, sorghum, millet, sugarcane, soybean, peanut, cotton, rapeseed and canola, *manihot*, pepper, sunflower and tagetes, solanaceous plants like potato, tobacco, eggplant, and tomato, *Vicia* species, pea, alfalfa, bushy plants (coffee, cacao, tea), *Salix* species, trees (oil palm, coconut), perennial grasses, and forage crops, these crop plants are also preferred target plants for a genetic engineering as one further embodiment of the present invention. Forage crops include, but are not limited to, Wheatgrass, Canarygrass, Bromegrass, Wildrye Grass, Bluegrass, Orchardgrass, Alfalfa, Salfoin, Birdsfoot Trefoil, Alsike Clover, Red Clover, and Sweet Clover.

In one embodiment of the present invention, transfection of an ACCDP into a plant is achieved by *Agrobacterium* mediated gene transfer. *Agrobacterium* mediated plant transformation can be performed using for example the GV3101 (pMP90) (Koncz and Schell, 1986, Mol. Gen. Genet. 204: 383-396) or LBA4404 (Clontech) *Agrobacterium tumefaciens* strain. Transformation can be performed by standard transformation and regeneration techniques (Deblaere et al., 1994, Nucl. Acids. Res. 13:4777-4788; Gelvin, Stanton B. and Schilperoort, Robert A, Plant Molecular Biology Manual, $2^{nd}$ Ed.—Dordrecht: Kluwer Academic Publ., 1995.—in Sect., Ringbuc Zentrale Signatur: BT11-P ISBN 0-7923-2731-4; Glick, Bernard R.; Thompson, John E., Methods in Plant Molecular Biology and Biotechnology, Boca Raton: CRC Press, 1993 360 S., ISBN 0-8493-5164-2). For example, rapeseed can be transformed via cotyledon or hypocotyl transformation (Moloney et al., 1989, Plant Cell Report 8:238-242; De Block et al., 1989, Plant Physiol. 91:694-701). Use of antibiotics for *Agrobacterium* and plant selection depends on the binary vector and the *Agrobacterium* strain used for transformation. Rapeseed selection is normally performed using kanamycin as the selectable plant marker. *Agrobacterium* mediated gene transfer to flax can be performed using, for example, a technique described by Mlynarova et al., 1994, Plant Cell Report 13:282-285. Additionally, transformation of soybean can be performed using for example a technique described in European Patent No. 0424 047, U.S. Pat. No. 5,322,783, European Patent No. 0397 687, U.S. Pat. No. 5,376,543, or U.S. Pat. No. 5,169,770. Transformation of maize can be achieved by particle bombardment, polyethylene glycol mediated DNA uptake, or via the silicon carbide fiber technique. (See, for example, Freeling and Walbot "The maize handbook" Springer Verlag: New York (1993) ISBN 3-540-97826-7). A specific example of maize transformation is found in U.S. Pat. No. 5,990,387, and a specific example of wheat transformation can be found in PCT Application No. WO 93/07256.

According to the present invention, the introduced ACCDP may be maintained in the plant cell stably if it is incorporated into a non-chromosomal autonomous replicon or integrated into the plant chromosomes. Alternatively, the introduced ACCDP may be present on an extra-chromosomal non-replicating vector and may be transiently expressed or transiently active.

In one embodiment, a homologous recombinant microorganism can be created wherein the ACCDP is integrated into a chromosome, a vector is prepared which contains at least a portion of an ACCDP gene into which a deletion, addition, or substitution has been introduced to thereby alter, e.g., functionally disrupt, the ACCDP gene. Preferably, the ACCDP gene is any of ACCDP genes as provided in Table 1 and Table 2, but it can be a homolog from a related plant or yeast, or even from a mammalian or insect source. In one embodiment, the vector is designed such that, upon homologous recombination, the endogenous ACCDP gene is functionally disrupted (i.e., no longer encodes a functional polypeptide; also referred to as a knock-out vector). Alternatively, the vector can be designed such that, upon homologous recombination, the endogenous ACCDP gene is mutated or otherwise altered but still encodes a functional polypeptide (e.g., the upstream regulatory region can be altered to thereby alter the expression of the endogenous ACCDP). To create a point mutation via homologous recombination, DNA-RNA hybrids can be used in a technique known as chimeraplasty (Cole-Strauss et al., 1999, Nucleic Acids Research 27(5):1323-1330 and Kmiec, 1999, Gene Therapy American Scientist 87(3):240-

247). Homologous recombination procedures in *Arabidopsis thaliana*, for example, are well known in the art and are contemplated for use herein.

Whereas in the homologous recombination vector, the altered portion of the ACCDP gene is flanked at its 5' and 3' ends by an additional nucleic acid molecule of the ACCDP gene to allow for homologous recombination to occur between the exogenous ACCDP gene carried by the vector and an endogenous ACCDP gene, in a microorganism or plant. The additional flanking ACCDP nucleic acid molecule is of sufficient length for successful homologous recombination with the endogenous gene. Typically, several hundreds of base pairs up to kilobases of flanking DNA (both at the 5' and 3' ends) are included in the vector (See e.g., Thomas, K. R., and Capecchi, M. R., 1987, Cell 51:503 for a description of homologous recombination vectors). The vector is introduced into a microorganism or plant cell (e.g., via polyethylene glycol mediated DNA), and cells in which the introduced ACCDP gene has homologously recombined with the endogenous ACCDP gene are selected using art-known techniques.

In another embodiment, recombinant microorganisms can be produced that contain selected systems that allow for regulated expression of the introduced gene. For example, inclusion of an ACCDP gene on a vector placing it under control of the lac operon permits expression of the ACCDP gene only in the presence of IPTG. Such regulatory systems are well known in the art.

Whether present in an extra-chromosomal non-replicating vector or a vector that is integrated into a chromosome, the ACCDP polynucleotide preferably resides in a plant expression cassette. A plant expression cassette preferably contains regulatory sequences capable of driving gene expression in plant cells that are operatively linked so that each sequence can fulfill its function, for example, termination of transcription by polyadenylation signals. Preferred polyadenylation signals are those originating from *Agrobacterium tumefaciens* t-DNA such as the gene 3 known as octopine synthase of the Ti-plasmid pTiACH5 (Gielen et al., 1984, EMBO J. 3:835) or functional equivalents thereof, but also all other terminators functionally active in plants are suitable. As plant gene expression is very often not limited on transcriptional levels, a plant expression cassette preferably contains other operatively linked sequences like translational enhancers such as the overdrive-sequence containing the 5'-untranslated leader sequence from tobacco mosaic virus enhancing the polypeptide per RNA ratio (Gallie et al., 1987, Nucl. Acids Research 15:8693-8711). Examples of plant expression vectors include those detailed in: Becker, D., Kemper, E., Schell, J. and Masterson, R., 1992, New plant binary vectors with selectable markers located proximal to the left border, Plant Mol. Biol. 20: 1195-1197; and Bevan, M. W., 1984, Binary *Agrobacterium* vectors for plant transformation, Nucl. Acid. Res. 12:8711-8721; Vectors for Gene Transfer in Higher Plants; in: Transgenic Plants, Vol. 1, Engineering and Utilization, eds.: Kung and R. Wu, Academic Press, 1993, S. 15-38.

Plant gene expression should be operatively linked to an appropriate promoter conferring gene expression in a timely, cell specific, or tissue specific manner. Promoters useful in the expression cassettes of the invention include any promoter that is capable of initiating transcription in a plant cell. Such promoters include, but are not limited to, those that can be obtained from plants, plant viruses, and bacteria that contain genes that are expressed in plants, such as *Agrobacterium* and *Rhizobium*.

The promoter may be constitutive, inducible, developmental stage-preferred, cell type-preferred, tissue-preferred, or organ-preferred. Constitutive promoters are active under most conditions. Examples of constitutive promoters include the CaMV 19S and 35S promoters (Odell et al., 1985, Nature 313:810-812), the sX CaMV 35S promoter (Kay et al., 1987, Science 236:1299-1302) the Sep1 promoter, the rice actin promoter (McElroy et al., 1990, Plant Cell 2:163-171), the *Arabidopsis* actin promoter, the ubiquitan promoter (Christensen et al., 1989, Plant Molec. Biol. 18:675-689), pEmu (Last et al., 1991, Theor. Appl. Genet. 81:581-588), the figwort mosaic virus 35S promoter, the Smas promoter (Velten et al., 1984, EMBO J. 3:2723-2730), the super-promoter (U.S. Pat. No. 5,955,646), the GRP1-8 promoter, the cinnamyl alcohol dehydrogenase promoter (U.S. Pat. No. 5,683,439), promoters from the T-DNA of *Agrobacterium*, such as mannopine synthase, nopaline synthase, and octopine synthase, the small subunit of ribulose biphosphate carboxylase (ssuRUBISCO) promoter, and the like.

Inducible promoters are preferentially active under certain environmental conditions, such as the presence or absence of a nutrient or metabolite, heat or cold, light, pathogen attack, anaerobic conditions, and the like. For example, the hsp80 promoter from *Brassica* is induced by heat shock; the PPDK promoter is induced by light; the PR-1 promoter from tobacco, *Arabidopsis*, and maize are inducible by infection with a pathogen; and the Adh1 promoter is induced by hypoxia and cold stress. Plant gene expression can also be facilitated via an inducible promoter (For review, see Gatz, 1997, Annu. Rev. Plant Physiol. Plant Mol. Biol. 48:89-108). Chemically inducible promoters are especially suitable if gene expression is wanted to occur in a time specific manner. Examples of such promoters are a salicylic acid inducible promoter (PCT Application No. WO 95/19443), a tetracycline inducible promoter (Gatz et al., 1992, Plant J. 2:397-404), and an ethanol inducible promoter (PCT Application No. WO 93/21334).

In one preferred embodiment of the present invention, the inducible promoter is a stress-inducible promoter. For the purposes of the invention, stress inducible promoters are preferentially active under one or more of the following stresses: sub-optimal conditions associated with salinity, drought, temperature, metal, chemical, pathogenic, and oxidative stresses. Stress inducible promoters include, but are not limited to, Cor78 (Chak et al., 2000, Planta 210:875-883; Hovath et al., 1993, Plant Physiol. 103:1047-1053), Cor15a (Artus et al., 1996, PNAS 93(23):13404-09), Rci2A (Medina et al., 2001, Plant Physiol. 125:1655-66; Nylander et al., 2001, Plant Mol. Biol. 45:341-52; Navarre and Goffeau, 2000, EMBO J. 19:2515-24; Capel et al., 1997, Plant Physiol. 115: 569-76), Rd22 (Xiong et al., 2001, Plant Cell 13:2063-83; Abe et al., 1997, Plant Cell 9:1859-68; Iwasaki et al., 1995, Mol. Gen. Genet. 247:391-8), cDet6 (Lang and Palve, 1992, Plant Mol. Biol. 20:951-62), ADH1 (Hoeren et al., 1998, Genetics 149:479-90), KAT1 (Nakamura et al., 1995, Plant Physiol. 109:371-4), KST1 (Müller-Röber et al., 1995, EMBO 14:2409-16), Rha1 (Terryn et al., 1993, Plant Cell 5:1761-9; Terryn et al., 1992, FEBS Lett. 299(3):287-90), ARSK1 (Atkinson et al., 1997, GenBank Accession # L22302, and PCT Application No. WO 97/20057), PtxA (Plesch et al., GenBank Accession # X67427), SbHRGP3 (Alm et al., 1996, Plant Cell 8:1477-90), GH3 (Liu et al., 1994, Plant Cell 6:645-57), the pathogen inducible PRP1-gene promoter (Ward et al., 1993, Plant. Mol. Biol. 22:361-366), the heat inducible hsp80-promoter from tomato (U.S. Pat. No. 5,187, 267), cold inducible alpha-amylase promoter from potato (PCT Application No. WO 96/12814), or the wound-inducible pinII-promoter (European Patent No. 375091). For other examples of drought, cold, and salt-inducible promoters, such as the RD29A promoter, see Yamaguchi-Shinozalei et al., 1993, Mol. Gen. Genet. 236:331-340.

Developmental stage-preferred promoters are preferentially expressed at certain stages of development. Tissue and organ preferred promoters include those that are preferentially expressed in certain tissues or organs, such as leaves, roots, seeds, or xylem. Examples of tissue preferred and organ preferred promoters include, but are not limited to fruit-preferred, ovule-preferred, male tissue-preferred, seed-preferred, integument-preferred, tuber-preferred, stalk-preferred, pericarp-preferred, and leaf-preferred, stigma-preferred, pollen-preferred, anther-preferred, a petal-preferred, sepal-preferred, pedicel-preferred, silique-preferred, stem-preferred, root-preferred promoters, and the like. Seed preferred promoters are preferentially expressed during seed development and/or germination. For example, seed preferred promoters can be embryo-preferred, endosperm preferred, and seed coat-preferred. See Thompson et al., 1989, BioEssays 10:108. Examples of seed preferred promoters include, but are not limited to, cellulose synthase (celA), Cim1, gamma-zein, globulin-1, maize 19 kD zein (cZ19B1), and the like.

Other suitable tissue-preferred or organ-preferred promoters include the napin-gene promoter from rapeseed (U.S. Pat. No. 5,608,152), the USP-promoter from *Vicia faba* (Baeumlein et al., 1991, Mol. Gen. Genet. 225(3):459-67), the oleosin-promoter from *Arabidopsis* (PCT Application No. WO 98/45461), the phaseolin-promoter from *Phaseolus vulgaris* (U.S. Pat. No. 5,504,200), the Bce-4-promoter from *Brassica* (PCT Application No. WO 91/13980), or the legumin B4 promoter (LeB4; Baeumlein et al., 1992, Plant Journal, 2(2): 233-9), as well as promoters conferring seed specific expression in monocot plants like maize, barley, wheat, rye, rice, etc. Suitable promoters to note are the lpt2 or lpt1-gene promoter from barley (PCT Application No. WO 95/15389 and PCT Application No. WO 95/23230) or those described in PCT Application No. WO 99/16890 (promoters from the barley hordein-gene, rice glutelin gene, rice oryzin gene, rice prolamin gene, wheat gliadin gene, wheat glutelin gene, oat glutelin gene, *Sorghum kasirin*-gene, and rye secalin gene).

Other promoters useful in the expression cassettes of the invention include, but are not limited to, the major chlorophyll a/b binding protein promoter, histone promoters, the Ap3 promoter, the β-conglycin promoter, the napin promoter, the soybean lectin promoter, the maize 15 kD zein promoter, the 22 kD zein promoter, the 27 kD zein promoter, the g-zein promoter, the waxy, shrunken 1, shrunken 2, and bronze promoters, the Zm13 promoter (U.S. Pat. No. 5,086,169), the maize polygalacturonase promoters (PG) (U.S. Pat. Nos. 5,412,085 and 5,545,546), and the SGB6 promoter (U.S. Pat. No. 5,470,359), as well as synthetic or other natural promoters.

Additional flexibility in controlling heterologous gene expression in plants may be obtained by using DNA binding domains and response elements from heterologous sources (i.e., DNA binding domains from non-plant sources). An example of such a heterologous DNA binding domain is the LexA DNA binding domain (Brent and Ptashne, 1985, Cell 43:729-736).

The invention further provides a recombinant expression vector comprising an ACCDP DNA molecule of the invention cloned into the expression vector in an antisense orientation. That is, the DNA molecule is operatively linked to a regulatory sequence in a manner that allows for expression (by transcription of the DNA molecule) of an RNA molecule that is antisense to an ACCDP mRNA. Regulatory sequences operatively linked to a nucleic acid molecule cloned in the antisense orientation can be chosen which direct the continuous expression of the antisense RNA molecule in a variety of cell types. For instance, viral promoters and/or enhancers, or regulatory sequences can be chosen which direct constitutive, tissue specific, or cell type specific expression of antisense RNA. The antisense expression vector can be in the form of a recombinant plasmid, phagemid, or attenuated virus wherein antisense nucleic acids are produced under the control of a high efficiency regulatory region. The activity of the regulatory region can be determined by the cell type into which the vector is introduced. For a discussion of the regulation of gene expression using antisense genes, see Weintraub, H. et al., 1986, Antisense RNA as a molecular tool for genetic analysis, Reviews—Trends in Genetics, Vol. 1(1), and Mol et al., 1990, FEBS Letters 268:427-430.

Another aspect of the invention pertains to host cells into which a recombinant expression vector of the invention has been introduced. The terms "host cell" and "recombinant host cell" are used interchangeably herein. It is understood that such terms refer not only to the particular subject cell but they also apply to the progeny or potential progeny of such a cell. Because certain modifications may occur in succeeding generations due to either mutation or environmental influences, such progeny may not, in fact, be identical to the parent cell, but are still included within the scope of the term as used herein. A host cell can be any prokaryotic or eukaryotic cell. For example, an ACCDP can be expressed in bacterial cells such as *C. glutamicum*, insect cells, fungal cells, or mammalian cells (such as Chinese hamster ovary cells (CHO) or COS cells), algae, ciliates, plant cells, fungi, or other microorganisms like *C. glutamicum*. Other suitable host cells are known to those skilled in the art.

A host cell of the invention, such as a prokaryotic or eukaryotic host cell in culture, can be used to produce (i.e., express) an ACCDP. Accordingly, the invention further provides methods for producing ACCDPs using the host cells of the invention. In one embodiment, the method comprises culturing the host cell of invention (into which a recombinant expression vector encoding an ACCDP has been introduced, or into which genome has been introduced a gene encoding a wild-type or altered ACCDP) in a suitable medium until the ACCDP is produced. In another embodiment, the method further comprises isolating ACCDPs from the medium or the host cell.

Another aspect of the invention pertains to isolated ACCDPs, and biologically active portions thereof. An "isolated" or "purified" polypeptide or biologically active portion thereof is free of some of the cellular material when produced by recombinant DNA techniques, or chemical precursors or other chemicals when chemically synthesized. The language "substantially free of cellular material" includes preparations of ACCDP in which the polypeptide is separated from some of the cellular components of the cells in which it is naturally or recombinantly produced. In one embodiment, the language "substantially free of cellular material" includes preparations of an ACCDP having less than about 30% (by dry weight) of non-ACCDP material (also referred to herein as a "contaminating polypeptide"), more preferably less than about 20% of non-ACCDP material, still more preferably less than about 10% of non-ACCDP material, and most preferably less than about 5% non-ACCDP material.

The nucleic acid molecules, polypeptides, polypeptide homologs, fusion polypeptides, primers, vectors, and host cells described herein can be used in one or more of the following methods: identification of any of the organisms as provided in Column No. 2 of Table 1 and Table 2 and related organisms; mapping of genomes of organisms related to any of the organisms as provided in Column No. 2 of Table 1 and Table 2; identification and localization of the sequences of interest of any of the organisms as provided in Column No. 2 of Table 1 and Table 2; evolutionary studies; determination of ACCDP regions required for function; modulation of an ACCDP activity; modulation of the metabolism of one or more cell functions; modulation of the transmembrane transport of one or more compounds; modulation of stress resistance; and modulation of expression of ACCDP nucleic acids. In one embodiment of these methods, the ACCDP can convert ACC to α-ketobutyrate and ammonia.

The ACCDP nucleic acid molecules according to the invention have a variety of uses. Most importantly, the nucleic acid and amino acid sequences of the present invention can be used to transform plants, particularly crop plants, thereby inducing tolerance to stresses such as drought, high salinity, and cold. The present invention therefore provides a transgenic plant transformed by an ACCDP nucleic acid, wherein expression of the nucleic acid sequence in the plant results in increased root growth and/or tolerance to environmental stress as compared to a wild type variety of the plant. The transgenic plant can be a monocot or a dicot. The invention further provides that the transgenic plant can be selected from maize, wheat, rye, oat, triticale, rice, barley, sorghum, millet, sugarcane, soybean, peanut, cotton, rapeseed, canola, manihot, pepper, sunflower, tagetes, solanaceous plants, potato, tobacco, eggplant, tomato, *Vicia* species, pea, alfalfa, coffee, cacao, tea, *Salix* species, oil palm, coconut, perennial grass, and forage crops, for example.

In particular, the present invention describes using the expression of ACCDP coding nucleic acids to engineer plants with increased root growth, and/or increased yield, and/or that are drought-tolerant, salt-tolerant, and/or cold-tolerant. This strategy has herein been demonstrated using AtACCD (SEQ ID NO:1) in *Arabidopsis thaliana* and corn, but its application is not restricted to this gene or to these plants. Accordingly, the invention provides a transgenic crop plant containing an ACCDP as defined in any of SEQ ID NOS as provided in Column No. 4 of Table 1 and Table 2, wherein the plant has increased root growth, and/or increased yield, and/ or increased tolerance to an environmental stress selected from one or more of the group consisting of drought, increased salt, or decreased or increased temperature. In preferred embodiments, the environmental stress is drought. In other preferred embodiments, the increased root growth is an increase in root length, preferably under water-limiting conditions.

The invention also provides a method of producing a transgenic crop plant containing an ACCDP coding nucleic acid, wherein expression of the nucleic acid(s) in the plant results in increased root growth, and/or increased yield, and/or increased tolerance to environmental stress as compared to a wild type variety of the plant comprising: (a) introducing into a plant cell an expression vector comprising an ACCDP nucleic acid, and (b) generating from the plant cell a transgenic plant with a increased root growth, and/or increased yield, and/or increased tolerance to environmental stress as compared to a wild type variety of the plant. The plant cell includes, but is not limited to, a protoplast, gamete producing cell, and a cell that regenerates into a whole plant. As used herein, the term "transgenic" refers to any plant, plant cell, callus, plant tissue, or plant part that contains all or part of at least one recombinant polynucleotide. In many cases, all or part of the recombinant polynucleotide is stably integrated into a chromosome or stable extra-chromosomal element, so that it is passed on to successive generations. In preferred embodiments, the ACCDP nucleic acid encodes a protein comprising the polypeptide of any of SEQ ID NOS as provided in Column No. 4 of Table 1 and Table 2.

The present invention also provides a method of modulating a plant's root growth, and/or yield, and/or tolerance to an environmental stress comprising, modifying the expression of an ACCDP coding nucleic acid in the plant. The plant's root growth, and/or yield, and/or tolerance to the environmental stress can be increased or decreased as achieved by increasing or decreasing the expression of an ACCDP, respectively. Preferably, the plant's root growth, and/or yield, and/or tolerance to the environmental stress is increased by increasing expression of an ACCDP. Expression of an ACCDP can be modified by any method known to those of skill in the art. The methods of increasing expression of ACCDPs can be used wherein the plant is either transgenic or not transgenic. In cases when the plant is transgenic, the plant can be transformed with a vector containing any of the above described ACCDP coding nucleic acids, or the plant can be transformed with a promoter that directs expression of native ACCDP in the plant, for example. The invention provides that such a promoter can be tissue preferred, developmentally regulated, stress inducible, or a combination thereof. Alternatively, nontransgenic plants can have native ACCDP expression modified by inducing a native promoter. The expression of ACCDP as defined in any of SEQ ID NOS as provided in Column No. 4 of Table 1 and Table 2 in target plants can be accomplished by, but is not limited to, one of the following examples: (a) constitutive promoter, (b) stress-inducible promoter, (c) chemical-induced promoter, and (d) engineered promoter overexpression with, for example, zinc-finger derived transcription factors (Greisman and Pabo, 1997, Science 275: 657).

In a preferred embodiment, transcription of the ACCDP is modulated using zinc-finger derived transcription factors (ZFPs) as described in Greisman and Pabo, 1997, Science 275:657 and manufactured by Sangamo Biosciences, Inc. These ZFPs comprise both a DNA recognition domain and a functional domain that causes activation or repression of a target nucleic acid such as an ACCDP nucleic acid. Therefore, activating and repressing ZFPs can be created that specifically recognize the ACCDP promoters described above and used to increase or decrease ACCDP expression in a plant, thereby modulating the yield and/or stress tolerance of the plant. The present invention also includes identification of the homologs of ACCDP coding nucleic acids as defined in any of SEQ ID NOS as provided in Column No. 3 of Table 1 and Table 2 in a target plant, as well as the homolog's promoter. The invention also provides a method of increasing expression of a gene of interest within a host cell as compared to a wild type variety of the host cell, wherein the gene of interest is transcribed in response to an ACCDP, comprising: (a) transforming the host cell with an expression vector comprising an ACCDP coding nucleic acid, and (b) expressing the ACCDP within the host cell, thereby increasing the expression of the gene transcribed in response to the ACCDP, as compared to a wild type variety of the host cell.

In addition to introducing the ACCDP nucleic acid sequences into transgenic plants, these sequences can also be used to identify an organism as being any of the organisms as provided in Column No. 2 of Table 1 and Table 2, or a close relative thereof. Also, they may be used to identify the presence of any of the organisms as provided in Column No. 2 of Table 1 and Table 2, or a relative thereof in a mixed population of organisms. The invention relates to the nucleic acid sequences of a number of genes from any of the organisms as provided in Column No. 2 of Table 1 and Table 2; by probing the extracted genomic DNA of a culture of a unique or mixed population of organisms under stringent conditions with a probe spanning a region of a particular gene that is unique to the corresponding organism according to Table 1 and Table 2, one can ascertain whether this organism is present.

Further, the nucleic acid and polypeptide molecules according to the invention may serve as markers for specific regions of the genome. This has utility not only in the mapping of the genome, but also in functional studies of the polypeptides encoded by such genome. For example, to identify the region of the genome to which a particular organism's DNA-binding polypeptide binds, the organism's genome could be digested, and the fragments incubated with the DNA-binding polypeptide. Those fragments that bind the polypeptide may be additionally probed with the nucleic acid molecules of the invention, preferably with readily detectable labels. Binding of such a nucleic acid molecule to the genome fragment enables the localization of the fragment to the genome map of such an organism and, when performed multiple times with different enzymes, facilitates a rapid determination of the nucleic acid sequence to which the polypeptide binds. Further, the nucleic acid molecules of the invention may be sufficiently identical to the sequences of related species such that these nucleic acid molecules may serve as markers for the construction of a genomic map in related plants.

The ACCDP nucleic acid molecules of the invention are also useful for evolutionary and polypeptide structural studies. The amino acid conversion processes in which the molecules of the invention participate are utilized by a wide variety of prokaryotic and eukaryotic cells; by comparing the sequences of the nucleic acid molecules of the present invention to those encoding similar enzymes from other organisms, the evolutionary relatedness of the organisms can be assessed. Similarly, such a comparison permits an assessment of which regions of the sequence are conserved and which are not, which may aid in determining those regions of the polypeptide that are essential for the functioning of the enzyme. This type of determination is of value for polypeptide engineering studies and may give an indication of what the polypeptide can tolerate in terms of mutagenesis without losing function.

Manipulation of the ACCDP nucleic acid molecules of the invention may result in the production of ACCDPs having functional differences from the wild-type ACCDPs. These polypeptides may be improved in efficiency or activity, may be present in greater numbers in the cell than is usual, or may be decreased in efficiency or activity.

There are a number of mechanisms by which the alteration of an ACCDP of the invention may directly affect root growth, and/or yield, and/or stress response and/or stress tolerance. In the case of plants expressing ACCDP, the enzyme might act to stimulate root elongation by sequestering and hydrolyzing ACC from germinating seeds, thus lowering the level of ACC and consequently lowering the level of ethylene in the seeds. For many plants, ethylene stimulates germination. It has been noted that if ethylene concentration remains high after germination, root elongation is inhibited (Jackson (1991), p. 159-181. In A. K. Matoo and J. C. Suttle (ed.) The Plant Hormone Ethylene, CRC Press, Boca Raton, Fla.). Therefore, lowering ethylene concentrations in seeds after germination leads to an increase in root length, and improved plant water use efficiency.

The effect of the genetic modification in plants, *C. glutamicum*, fungi, algae, or ciliates on root growth and/or stress tolerance can be assessed by growing the modified microorganism or plant under less than suitable conditions and then analyzing the growth characteristics and/or metabolism of the plant. Such analysis techniques are well known to one skilled in the art, and include dry weight, wet weight, polypeptide synthesis, carbohydrate synthesis, lipid synthesis, evapotranspiration rates, general plant and/or crop yield, flowering, reproduction, seed setting, root growth, respiration rates, photosynthesis rates, etc. (Applications of HPLC in Biochemistry in: Laboratory Techniques in Biochemistry and Molecular Biology, vol. 17; Rehm et al., 1993 Biotechnology, vol. 3, Chapter DI: Product recovery and purification, page 469-714, VCH: Weinheim; Belter, P. A. et al., 1988, Bioseparations: downstream processing for biotechnology, John Wiley and Sons; Kennedy, J. F. and Cabral, J. M. S., 1992, Recovery processes for biological materials, John Wiley and Sons; Shaeiwitz, J. A. and Henry, J. D., 1988, Biochemical separations, in: Ulmann's Encyclopedia of Industrial Chemistry, vol. B3, Chapter 11, page 1-27, VCH: Weinheim; and Dechow, F. J., 1989; Separation and purification techniques in biotechnology, Noyes Publications).

For example, yeast expression vectors comprising the nucleic acids disclosed herein, or fragments thereof, can be constructed and transformed into *Saccharomyces cerevisiae* using standard protocols. The resulting transgenic cells can then be assayed for fail or alteration of their increased growth and/or tolerance to drought, salt, and temperature stresses. Similarly, plant expression vectors comprising the nucleic acids disclosed herein, or fragments thereof, can be constructed and transformed into an appropriate plant cell such as *Arabidopsis*, soy, rape, maize, wheat, *Medicago truncatula*, etc., using standard protocols. The resulting transgenic cells and/or plants derived there from can then be assayed for fail or alteration of their increased root growth and/or tolerance to drought, salt, and temperature stresses.

Additionally, the sequences disclosed herein, or fragments thereof, can be used to generate knockout mutations in the genomes of various organisms, such as bacteria, mammalian cells, yeast cells, and plant cells (Girke, T., 1998, The Plant Journal 15:39-48). The resultant knockout cells can then be evaluated for their ability or capacity to tolerate various stress conditions, their response to various stress conditions, and the effect on the phenotype and/or genotype of the mutation. For other methods of gene inactivation, see U.S. Pat. No. 6,004,804 "Non-Chimeric Mutational Vectors" and Puttaraju et al., 1999, Spliceosome-mediated RNA trans-splicing as a tool for gene therapy, Nature Biotechnology 17:246-252.

The aforementioned mutagenesis strategies for ACCDPs resulting in increased root growth, and/or yield, and/or stress tolerance are not meant to be limiting; variations on these strategies will be readily apparent to one skilled in the art. Using such strategies, and incorporating the mechanisms disclosed herein, the nucleic acid and polypeptide molecules of the invention may be utilized to generate algae, ciliates, plants, fungi, or other microorganisms-like *C. glutamicum* expressing mutated ACCDP nucleic acid and polypeptide molecules such that the root growth and/or stress tolerance is improved.

The present invention also provides antibodies that specifically bind to an ACCDP, or a portion thereof, as encoded by a nucleic acid described herein. Antibodies can be made by many well-known methods (See, e.g., Harlow and Lane, "Antibodies; A Laboratory Manual," Cold Spring Harbor Laboratory, Cold Spring Harbor, N.Y., (1988)). Briefly, purified antigen can be injected into an animal in an amount and in intervals sufficient to elicit an immune response. Antibodies can either be purified directly, or spleen cells can be obtained from the animal. The cells can then fused with an immortal cell line and screened for antibody secretion. The antibodies can be used to screen nucleic acid clone libraries for cells secreting the antigen. Those positive clones can then be sequenced. (See, for example, Kelly et al., 1992, Bio/Technology 10:163-167; Bebbington et al., 1992, Bio/Technology 10:169-175).

The phrases "selectively binds" and "specifically binds" with the polypeptide refer to a binding reaction that is determinative of the presence of the polypeptide in a heterogeneous population of polypeptides and other biologics. Thus, under designated immunoassay conditions, the specified antibodies bound to a particular polypeptide do not bind in a significant amount to other polypeptides present in the sample. Selective binding of an antibody under such conditions may require an antibody that is selected for its specificity for a particular polypeptide. A variety of immunoassay formats may be used to select antibodies that selectively bind with a particular polypeptide. For example, solid-phase ELISA immunoassays are routinely used to select antibodies selectively immunoreactive with a polypeptide. See Harlow and Lane, "Antibodies, A Laboratory Manual" Cold Spring Harbor Publications, New York, (1988), for a description of immunoassay formats and conditions that could be used to determine selective binding.

In some instances, it is desirable to prepare monoclonal antibodies from various hosts. A description of techniques for preparing such monoclonal antibodies may be found in Stites et al., eds., "Basic and Clinical Immunology," (Lange Medical Publications, Los Altos, Calif., Fourth Edition) and references cited therein, and in Harlow and Lane "Antibodies, A Laboratory Manual" Cold Spring Harbor Publications, New York, 1988.

Throughout this application, various publications are referenced. The disclosures of all of these publications and those references cited within those publications in their entireties are hereby incorporated, by reference into this application in order to more fully describe the state of the art to which this invention pertains.

It should also be understood that the foregoing relates to preferred embodiments of the present invention and that numerous changes may be made therein without departing from the scope of the invention. The invention is further illustrated by the following examples, which are not to be construed in any way as imposing limitations upon the scope thereof. On the contrary, it is to be clearly understood that resort may be had to various other embodiments, modifications, and equivalents thereof, which, after reading the description herein, may suggest themselves to those skilled in the art without departing from the spirit of the present invention and/or the scope of the appended claims.

EXAMPLES

Example 1

Total DNA Isolation from Plant Material

The details for the isolation of total DNA relate to the working up of one gram fresh weight of plant material. The materials used include the following buffers: CTAB buffer: 2% (w/v) N-cethyl-N,N,N-trimethylammonium bromide (CTAB); 100 mM Tris HCl pH 8.0; 1.4 M NaCl; 20 mM EDTA; N-Laurylsarcosine buffer: 10% (w/v) N-laurylsarcosine; 100 mM Tris HCl pH 8.0; and 20 mM EDTA.

The plant material was triturated under liquid nitrogen in a mortar to give a fine powder and transferred to 2 ml Eppendorf vessels. The frozen plant material was then covered with a layer of 1 ml of decomposition buffer (1 ml CTAB buffer, 100 µl of N-laurylsarcosine buffer, 20 µl of β-mercaptoethanol, and 10 µl of proteinase K solution, 10 mg/ml) and incubated at 60° C. for one hour with continuous shaking. The homogenate obtained was distributed into two Eppendorf vessels (2 ml) and extracted twice by shaking with the same volume of chloroform/isoamyl alcohol (24:1). For phase separation, centrifugation was carried out at 8000×g and room temperature for 15 minutes in each case. The DNA was then precipitated at −70° C. for 30 minutes using ice-cold isopropanol. The precipitated DNA was sedimented at 4° C. and 10,000 g for 30 minutes and resuspended in 180 µl of TE buffer (Sambrook et al., 1989, Cold. Spring Harbor Laboratory Press: ISBN 0-87969-309-6). For further purification, the DNA was treated with NaCl (1.2 M final concentration) and precipitated again at −70° C. for 30 minutes using twice the volume of absolute ethanol. After a washing step with 70% ethanol, the DNA was dried and subsequently taken up in 50 µl of $H_2O$+RNAse (50 mg/ml final concentration). The DNA was dissolved overnight at 4° C., and the RNAse digestion was subsequently carried out at 37° C. for 1 hour. Storage of the DNA took place at 4° C.

Example 2

Preparation of Total RNA and cDNA from *Arabidopsis* Plant Material

AtACCD was isolated by preparing RNA from *Arabidopsis* leaves using the RNA mini-isolation kit (Qiagen kit) following the manufacturer's recommendations. Reverse transcription reactions and amplification of the cDNA were performed as described below.

1. Use 2 µl of RNA (0.5-2.0) preparation in a 10 µl Dnase reaction, move the tube to 37° C. for 15 minutes, add 1 µl 25 mM EDTA, and then heat reaction to 65° C. for 15 minutes.
   a. Buffer (10×: 200 mM Tris, 500 mM KCl, 20 mM $MgCl_2$)—1 µl
   b. RNA—2 µl
   c. Dnase (10 U/µl)—1 µl
   d. $H_2O$—6 µl
2. Use 1 µl of the above reaction in a room temperature reaction, and heat to 65° C. for 5 minutes.
   a. Dnased RNA (0.025-0.1 µg depending on the starting amount)—1 µl
   b. 10 mM dNTPs—1 µl
   c. Primer (10 µM)—1 µl
   d. $H_2$—up to 10 µl
3. Prepare a reaction mix with these reagents in a separate tube
   a. SuperScript II RT buffer (10×)—2 µl
   b. 25 mM $MgCl_2$—4 µl
   c. DTT (0.1 M)—2 µl
   d. Rnase Out Rnase Inhibitor (40 U/µl)—1 µl
4. Add the 9 µl reaction mix to the denatured RNA solution, and hold at 42° C. for 2 minutes.
5. Add 1 µl of SuperScriptII RT (50 U/µl), and incubate at 42° C. for 50 minutes.
6. Terminate reaction at 70° C. for 15 minutes.
7. Optional: add 1 µl of RNAseH to reaction to remove RNA.
8. Perform PCR as you would using 1-2 µl of the new cDNA.

Tissue Harvest, RNA Isolation, and cDNA Library Construction

Crop plants were grown under a variety of conditions and treatments, and different tissues were harvested at various developmental stages. Plant growth and harvesting were done in a strategic manner such that the probability of harvesting all expressable genes in at least one or more of the resulting libraries is maximized. The mRNA was isolated as described above from each of the collected samples, and cDNA libraries were constructed. No amplification steps were used in the library production process in order to minimize redundancy of genes within the sample and to retain expression information. All libraries were 3' generated from mRNA purified on oligo dT columns. Colonies from the transformation of the cDNA library into *E. coli* were randomly picked and placed into microtiter plates.

PCR Amplification of cDNA Inserts and Spotting

The cDNA inserts from each clone from the microtiter plates were PCR amplified. Plasmid DNA was isolated from the *E. coli* colonies and then spotted on membranes. No purification step was necessary prior to spotting samples to nylon membranes.

Example 3

Cloning of AtACCD

The cDNA isolated as described in Example 2 was used to clone the AtACCD gene by RT-PCR. The following primers were used: The forward primer was 5'-5'GGGGTCGAC-GAAGCAATGAGAGGACGAAGCT-3' (SEQ ID NO:358). The reverse primer was 5'-GGGTTAATTAACA-GATTTTGTTGTGCTAGAAC-3' (SEQ ID NO:359). PCR reactions for the amplification included: 1×PCR buffer, 0.2 mM dNTP, 100 ng *Arabidopsis thaliana* DNA, 25 pmol reverse primer, 2.5 u Pfu or Herculase DNA polymerase.

PCR was performed according to standard conditions and to manufacturer's protocols (Sambrook et al., 1989, Molecular Cloning, A Laboratory Manual, 2nd Edition, Cold Spring Harbor Laboratory Press, Cold Spring Harbor, N.Y., Biometra T3 Thermocycler). The parameters for the reaction were: 1 cycle for 3 minutes at 94° C.; followed by 25 cycles of 30 seconds at 94° C., 30 seconds at 55° C., and 1.5 minutes at 72° C.

The amplified fragments were then extracted from agarose gel with a QIAquick Gel Extraction Kit (Qiagen) and ligated into the TOPO pCR 2.1 vector (Invitrogen) following manufacture's instructions. Recombinant vectors were transformed into Top10 cells (Invitrogen) using standard conditions (Sambrook et al. 1989. Molecular Cloning, A Laboratory Manual, 2nd Edition, Cold Spring Harbor Laboratory Press, Cold Spring Harbor, N.Y.). Transformed cells were selected for on LB agar containing 100 μg/ml carbenicillin, 0.8 mg X-gal (5-bromo-4-chloro-3-indolyl-β-D-galactoside) and 0.8 mg IPTG (isopropylthio-β-D-galactoside) grown overnight at 37° C. White colonies were selected and used to inoculate 3 ml of liquid LB containing 100 μg/ml ampicillin and grown overnight at 37° C. Plasmid DNA was extracted using the QIAprep Spin Miniprep Kit (Qiagen) following manufacture's instructions. Analyses of subsequent clones and restriction mapping were performed according to standard molecular biology techniques (Sambrook et al., 1989, Molecular Cloning, A Laboratory Manual, 2nd Edition, Cold Spring Harbor Laboratory Press, Cold Spring Harbor, N.Y.).

The clones were sequenced, which confirmed that the identity of the cloned gene was identical to the sequence deposited in the *Arabidopsis thaliana* database (SEQ ID NO:1). The deduced amino acid sequence of AtACCD is shown at SEQ ID NO:2.

The AtACCD gene was then cloned into a binary vector and expressed under the Superpromoter (FIG. 3). The Superpromoter is constitutive, but root preferential (U.S. Pat. Nos. 5,428,147 and 5,217,903).

Example 4

*Arabidopsis* Plant Transformation

Transgenic *Arabidopsis thaliana* (Col) plants were generated by the dipping infiltration method (Bechtold et al., 1993, "In planta *Agrobacterium*-mediated gene transfer by infiltration of adult *Arabidopsis thaliana* plants," C. R. Acad. Sci. Paris Life Sci. 316:1194-1199). The binary vectors were transformed into *Agrobacteria* strain C58C1 or pMP90 using electroporation. Culture of the transformed *Agrobacteria* was grown, and the bacteria was resuspended in dipping infiltration media (½ MS, 5% sucrose, 0.5 mg/ml MES, pH 5.7 and with 200 ppm Silwet L-77 (Lehle Seeds) added.) Each culture was used to transform 3 pots of approximately 5 week-old Col0 *Arabidopsis* plants by dipping pots 5 minutes each in resuspended *Agrobacterium* cultures. The plants were then grown to seed under standard *Arabidopsis* conditions (23° C. day/20° C. night, 18 hour day and 65% humidity). T1 seeds were screened on MS plates using 100 nM Pursuit (BASF).

Screening of Transformed Plants

T1 seeds were sterilized according to standard protocols (Xiong et al., 1999, Plant Molecular Biology Reporter 17: 159-170). Seeds were selected on ½ Murashige and Skoog media (MS) (Sigma-Aldrich), 0.6% agar and supplemented with 1% sucrose, and 2 μg/ml benomyl (Sigma-Aldrich). Seeds on plates were vernalized for four days at 4° C. The seeds were germinated in a climatic chamber at an air temperature of 22° C. and light intensity of 40 micromols$^{-1m2}$ (white light; Philips TL 65W/25 fluorescent tube) and 16 hours light and 8 hours dark day length cycle. Transformed seedlings were selected after 14 days and transferred to ½ MS media supplemented with 0.6% agar, 1% sucrose, and allowed to recover for five to seven days.

Seeds of T2 generation were used for plant root analysis in soil and in vitro.

Example 5

In vitro Root Analysis of Transformed *Arabidopsis* Plants

For in vitro root analysis of transformed plants, square plates measuring 12 cm×12 cm were used. For each plate, 52 ml of MS media (0.5×MS salts, 0.5% sucrose, 0.5 g/L MES buffer, 1% Phytagar) without selection was used. Plates were allowed to dry in the sterile hood for one hour to reduce future condensation.

Seed aliquots were sterilized in glass vials with ethanol for 5 minutes, the ethanol was removed, and the seeds were allowed to dry in the sterile hood for one hour. Seeds were spotted in the plates using the Vacuseed Device (Lehle). In the experimental design, every plate contained both wild type and AtACCD transgenic plants. Therefore, every line was always compared to the controls grown in the same plate(s) to account for microenvironment variation. After the seeds were spotted on the plates, the plates were wrapped with Ventwrap and placed vertically in racks in the dark at 4° C. for four days to stratify the seeds. The plates were transferred to a C5 Percival Growth Chamber and placed vertically for fourteen days. The growth chamber conditions were 23° C. day/21° C. night and 16 hour days/8 hour nights.

For data collection a high resolution flat-bed scanner was used. Analysis of the roots was done using the WinRhizo software package.

The results of these experiments were also analyzed at the gene level. To do this, root length of all plants for all transgenic lines was averaged and compared against the average of the wild type plants. Presence of the transgene and copy number of the events were determined targeting the NOS terminator in real time PCR. The NOS Primers used for the analysis were: Forward primer 5'-TCCCCGATCGT-TCAAACATT-3' (SEQ ID NO:360), Reverse primer 5'-CCATCTCATAAATAACGTCATGCAT-3' (SEQ ID NO:361). The reactions were run in a 96-well optical plate (Applied Biosystems, 431-4320), and the endogenous control and gene of interest reactions were run on the same plate simultaneously. A master mix was made for both primer sets. The master mixes and the 96-well plate for assay should be kept on ice. Calculations are included for 52 reactions, which is suitable for half of the plate with use of a multichannel pipetter. The Eurogentec kit, (cat#RTSNRT032X-1) was used, and reactions were prepared using manufacturer's recommendations. A GeneAmp 5700 was used to run the reactions and collect data.

Results

The results show that transgenic AtACCD plants evaluated in plates have a longer root phenotype. FIG. 4A shows the results of the plants grown in vertical plates on a per line basis. The majority of AtACCD transgenic lines screened exhibited a longer root phenotype in comparison to wild-type control plant roots. The phenotype was more clearly observed in lines 2, 3, 5, 6, and 9.

The gene level analysis of the AtACCD transgenic plants, as seen in FIG. 4B, confirmed that the AtACCD plants exhibited an increased root length phenotype. Based on this analysis, ACCDP transgenic *Arabidopsis* plants exhibited a 13.8% increase in root length.

Example 6

Soil Root Analysis of Transformed *Arabidopsis* Plants

For soil root analysis, seeds were imbibed at 4° C. for 2 days in water and were planted directly in soil with no selection. Deepots (Hummert D40) were used with a saturated peat pellet (Jiffy 727) at the base and filled with water saturated Metromix. After planting, pots were covered with plastic wrap to prevent drying. Plants were grown using only water present at media preparation, as the water in the soil in these large pots is sufficient for 3 weeks of growth, and encourages rapid root growth. The plastic wrapping of the pots was removed after 12 days and morphological data was documented. At day 17 the aerial parts of the plant were harvested, dried at 65° C. for 2 days and the dry weight was measured. To examine the roots, the peat pellet was pushed towards the top of the pot to remove the soil and roots as a unit. The soil was then separated from the roots in a tray and the maximum root length was measured.

To determine the impact of the root phenotype in the above ground tissues of the transgenic plants, the dry weight of the rosette was measured and compared against the wild type plants.

Results

Roots of the AtACCD lines were also evaluated in soil as described above. The results indicated transgenic plants exhibited a longer root phenotype when plants are grown in soil (FIGS. 5 and 6). In general, all AtACCD lines analyzed exhibited increased growth in the soil-based assay. Lines 2, 4, 7, 10 and 11 showed the greatest increase in root length (FIG. 5). FIG. 6 shows the ANOVA of the overall performance of the AtACCD gene, demonstrating that the AtACCD transgenic plants performed significantly better than the wild type controls.

The dry weight of the rosette was measured, and the ANOVA analysis of the results is shown in FIG. 7. No significant differences were observed between the transgenic plants and the wild type controls. Therefore the rosette biomass does not appear to be affected by the over-expression of the AtACCD gene.

Example 7

Identification of Homologs to AtACCD

The algorithms used in the present invention include: FASTA (Very sensitive sequence database searches with estimates of statistical significance; Pearson, 1990, Rapid and sensitive sequence comparison with FASTP and FASTA, Methods Enzymol. 183:63-98); BLAST (Very sensitive sequence database searches with estimates of statistical significance; Altschul et al., Basic local alignment search tool, Journal of Molecular Biology 215:403-10); PREDATOR (High-accuracy secondary structure prediction from single and multiple sequences; Frishman and Argos, 1997, 75% accuracy in protein secondary structure prediction. Proteins 27:329-335); CLUSTALW (Multiple sequence alignment; Thompson et al., 1994, CLUSTAL W (improving the sensitivity of progressive multiple sequence alignment through sequence weighting, positions-specific gap penalties and weight matrix choice), Nucleic Acids Research 22:4673-4680); TMAP (Transmembrane region prediction from multiply aligned sequences; Persson and Argos, 1994, Prediction of transmembrane segments in proteins utilizing multiple sequence alignments, J. Mol. Biol. 237:182-192); ALOM2 (Transmembrane region prediction from single sequences; Klein et al., Prediction of protein function from sequence properties: A discriminate analysis of a database. Biochim. Biophys. Acta 787:221-226 (1984). Version 2 by Dr. K. Nakai); PROSEARCH (Detection of PROSITE protein sequence patterns; Kolakowski et al., 1992, ProSearch: fast searching of protein sequences with regular expression patterns related to protein structure and function. Biotechniques 13, 919-921); BLIMPS (Similarity searches against a database of ungapped blocks, Wallace and Henikoff, 1992); PATMAT (a searching and extraction program for sequence, pattern and block queries and databases, CABIOS 8:249-254. Written by Bill Alford).

Homologs of the AtACCD gene were found in the public and proprietary databases. These homologs were evaluated to determine the level of relationship to AtACCD. The tblastn program from the BLAST family of algorithms was used to compare the AtACCD protein sequence against the proprietary crop databases translated in all six reading frames. Sequences with significant homology were found in each crop library. The sequence identity percentage at amino acid level of each sequence as compared to AtACCD is shown in Column No. 5 of Table 1 and Table 2.

The BLAST alignments at amino acid level between AtACCD (SEQ ID NO:2) and ACCDP from crops such as soybean, rice, maize and wheat are shown in FIGS. 9-12. The ACCDP from soybean, rice, maize and wheat as shown in FIGS. 9-12 are considered to be full-length. Full length sequences for the remaining partial sequences may be obtained using primer sequences based on the disclosed partial cDNA sequences using standard molecular biology techniques (See Sambrook et al., 1989, Molecular Cloning, A

Example 8

Engineering Soybean Plants by Overexpressing the ACCDP Gene

Seeds of soybean are surface sterilized with 70% ethanol for 4 minutes at room temperature with continuous shaking, followed by 20% (v/v) Clorox supplemented with 0.05% (v/v) Tween for 20 minutes with continuous shaking. Then, the seeds are rinsed 4 times with distilled water and placed on moistened sterile filter paper in a Petri dish at room temperature for 6 to 39 hours. The seed coats are peeled off, and cotyledons are detached from the embryo axis. The embryo axis is examined to make sure that the meristematic region is not damaged. The excised embryo axes are collected in a half-open sterile Petri dish and air-dried to a moisture content less than 20% (fresh weight) in a sealed Petri dish until further use.

Agrobacterium tumefaciens culture is prepared from a single colony in LB solid medium plus appropriate selection agents followed by growth of the single colony in liquid LB medium to an optical density at 600 nm of 0.8. Then, the bacteria culture is pelleted at 7000 rpm for 7 minutes at room temperature, and resuspended in MS medium supplemented with 100 µM acetosyringone. Bacteria cultures are incubated in this pre-induction medium for 2 hours at room temperature before use. The axis of soybean zygotic seed embryos at approximately 15% moisture content are imbibed for 2 hours at room temperature with the pre-induced Agrobacterium suspension culture. The embryos are removed from the imbibition culture and are transferred to Petri dishes containing solid MS medium supplemented with 2% sucrose and incubated for 2 days in the dark at room temperature. Alternatively, the embryos are placed on top of moistened (liquid MS medium) sterile filter paper in a Petri dish and incubated under the same conditions described above. After this period, the embryos are transferred to either solid or liquid MS medium supplemented with 500 mg/L carbenicillin or 300 mg/L cefotaxime to kill the Agrobacteria. The liquid medium is used to moisten the sterile filter paper. The embryos are incubated during 4 weeks at 25° C., under 150 µmol m$^{-2}$ sec$^{-1}$ and 12 hours photoperiod. Once the seedlings produce roots, they are transferred to sterile metromix soil. The medium of the in vitro plants is washed off before transferring the plants to soil. The plants are kept under a plastic cover for 1 week to favor the acclimatization process. Then the plants are transferred to a growth room where they are incubated at 25° C., under 150 µmol m$^{-2}$ sec$^{-1}$ light intensity and 12 hours photoperiod for about 80 days.

The transgenic plants are screened for their improved root growth and/or stress tolerance, demonstrating that transgene expression confers increased root growth, stress tolerance, and/or increased water use efficiency.

Example 9

Engineering Rapeseed/Canola Plants by Overexpressing the ACCDP Gene

The method of plant transformation described herein is applicable to Brassica and other crops. Seeds of canola are surface sterilized with 70% ethanol for 4 minutes at room temperature with continuous shaking, followed by 20% (v/v) Clorox supplemented with 0.05% (v/v) Tween for 20 minutes, at room temperature with continuous shaking. Then, the seeds are rinsed 4 times with distilled water and placed on moistened sterile filter paper in a Petri dish at room temperature for 18 hours. Then the seed coats are removed, and the seeds are air dried overnight in a half-open sterile Petri dish. During this period, the seeds lose approximately 85% of their water content. The seeds are then stored at room temperature in a sealed Petri dish until further use. DNA constructs and embryo imbibition are as described in Example 10. Samples of the primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

The transgenic plants are screened for their improved root growth and/or stress tolerance, demonstrating that transgene expression confers increased root growth, stress tolerance, and/or increased water use efficiency.

Example 10

Engineering Corn Plants by Overexpressing the ACCDP Gene

Transformation of maize (Zea Mays L.) with the gene of interest is performed with the method described by Ishida et al., 1996, Nature Biotech. 14745-50. Immature embryos are co-cultivated with Agrobacterium tumefaciens that carry "super binary" vectors, and transgenic plants are recovered through organogenesis. This procedure provides a transformation efficiency of between 2.5% and 20%. The transgenic plants are screened for their improved root growth and/or stress tolerance, demonstrating that transgene expression confers increased root growth, stress tolerance, and/or increased water use efficiency.

Example 11

Engineering Rice Plants by Overexpressing the ACCDP Gene

Transformation of rice with the gene of interest can be undertaken by direct gene transfer techniques utilizing protoplasts or particle bombardment. Protoplast-mediated transformation has been described for Japonica-types and Indica-types (Zhang et al., 1988, Plant Cell Rep. 7:379-384; Shimamoto et al., 1989, Nature 338:274-277; Datta et al., 1990, Biotechnology 8:736-740). Both types are also routinely transformable using particle bombardment (Christou et al., 1991, Biotechnology 9:957-962). The transgenic plants are screened for their improved growth and/or stress tolerance, demonstrating that transgene expression confers increased root growth, stress tolerance, and/or increased water use efficiency.

Example 12

Identification of Homologous and Heterologous Genes

Gene sequences can be used to identify homologous or heterologous genes from cDNA or genomic libraries. Homologous genes (e.g. full-length cDNA clones) can be isolated via nucleic acid hybridization using for example cDNA libraries. Depending on the abundance of the gene of interest, 100,000 up to 1,000,000 recombinant bacteriophages are plated and transferred to nylon membranes. After denaturation with alkali, DNA is immobilized on the membrane by, e.g., UV cross linking. Hybridization is carried out at high stringency conditions. In aqueous solution, hybridization and washing is performed at an ionic strength of 1 M NaCl and a temperature of 68° C. Hybridization probes are generated by, e.g., radioactive ($^{32}$P) nick transcription labeling (High Prime, Roche, Mannheim, Germany). Signals are detected by autoradiography.

Partially homologous or heterologous genes that are related but not identical can be identified in a manner analogous to the above-described procedure using low stringency hybridization and washing conditions. For aqueous hybridization, the ionic strength is normally kept at 1 M NaCl while the temperature is progressively lowered from 68 to 42° C.

Isolation of gene sequences with homologies (or sequence identity/similarity) only in a distinct domain of (for example 10-20 amino acids) can be carried out by using synthetic radio labeled oligonucleotide probes. Radiolabeled oligonucleotides are prepared by phosphorylation of the 5-prime end of two complementary oligonucleotides with T4 polynucleotide kinase. The complementary oligonucleotides are annealed and ligated to form concatemers. The double stranded concatemers are then radiolabeled by, for example, nick transcription. Hybridization is normally performed at low stringency conditions using high oligonucleotide concentrations.

Oligonucleotide Hybridization Solution:
6×SSC
0.01 M sodium phosphate
1 mM EDTA (pH 8)
0.5% SDS
100 µg/ml denatured salmon sperm DNA
0.1% nonfat dried milk During hybridization, the temperature is lowered stepwise to 5-10° C. below the estimated oligonucleotide $T_m$, or down to room temperature, followed by washing steps and autoradiography. Washing is performed with low stringency, such as 3 washing steps using 4×SSC. Further details are described by Sambrook, J. et al., 1989, "Molecular Cloning: A Laboratory Manual", Cold Spring Harbor Laboratory Press or Ausubel, F. M. et al., 1994, "Current Protocols in Molecular Biology", John Wiley & Sons.

Example 13

Identification of Homologous Genes by Screening Expression Libraries with Antibodies c-DNA clones can be used to produce recombinant protein for example in *E. coli* (e.g. Qiagen QIAexpress pQE system). Recombinant proteins are then normally affinity purified via Ni-NTA affinity chromatography (Qiagen). Recombinant proteins are then used to produce specific antibodies for example by using standard techniques for rabbit immunization. Antibodies are affinity purified using a Ni-NTA column saturated with the recombinant antigen as described by Gu et al., 1994, BioTechniques 17:257-262. The antibody can be used to screen expression cDNA libraries to identify homologous or heterologous genes via an immunological screening (Sambrook, J. et al., 1989, "Molecular Cloning: A Laboratory Manual", Cold Spring Harbor Laboratory. Press or Ausubel, F. M. et al., 1994, "Current Protocols in Molecular Biology", John Wiley & Sons).

Example 14

In Vivo Mutagenesis

In vivo mutagenesis of microorganisms can be performed by passage of plasmid (or other vector) DNA through *E. coli* or other microorganisms (e.g. *Bacillus* spp. or yeasts such as *Saccharomyces cerevisiae*) which are impaired in their capabilities to maintain the integrity of their genetic information. Typical mutator strains have mutations in the genes for the DNA repair system (e.g., mutHLS, mutD, mutT, etc.; for reference, see Rupp, W. D., 1996, DNA repair mechanisms, in: *Escherichia coli* and *Salmonella*, p. 2277-2294, ASM: Washington.) Such strains are well known to those skilled in the art. The use of such strains is illustrated, for example, in Greener, A. and Callahan, M., 1994, Strategies 7:32-34. Transfer of mutated DNA molecules into plants is preferably done after selection and testing in microorganisms. Transgenic plants are generated according to various examples within the exemplification of this document.

Example 15

In vitro Analysis of the Function of *Arabidopsis* Genes in Transgenic Organisms The determination of activities and kinetic parameters of enzymes is well established in the art. Experiments to determine the activity of any given altered enzyme must be tailored to the specific activity of the wild-type enzyme, which is well within the ability of one skilled in the art. Overviews about enzymes in general, as well as specific details concerning structure, kinetics, principles, methods, applications, and examples for the determination of many enzyme activities may be found, for example, in the following references: Dixon, M., and Webb, E. C., 1979, Enzymes. Longmans: London; Fersht, 1985, Enzyme Structure and Mechanism. Freeman: New York; Walsh, 1979, Enzymatic Reaction Mechanisms. Freeman: San Francisco; Price, N. C., Stevens, L.; 1982, Fundamentals of Enzymology. Oxford Univ. Press: Oxford; Boyer, P. D., ed., 1983, The Enzymes, 3$^{rd}$ ed. Academic Press: New York; Bisswanger, H., 1994, Enzymkinetik, 2$^{nd}$ ed. VCH: Weinheim (ISBN 3527300325); Bergmeyer, H. U., Bergmeyer, J., Graβl, M., eds., 1983-1986, Methods of Enzymatic Analysis, 3$^{rd}$ ed., vol. I-XII, Verlag Chemie: Weinheim; and Ullmann's Encyclopedia of Industrial Chemistry, 1987, vol. A9, Enzymes. VCH: Weinheim, p. 352-363.

The activity of proteins which bind to DNA can be measured by several well-established methods, such as DNA band-shift assays (also called gel retardation assays). The effect of such proteins on the expression of other molecules can be measured using reporter gene assays (such as that described in Kolmar, H. et al., 1995, EMBO J. 14: 3895-3904 and references cited therein). Reporter gene test systems are well known and established for applications in both pro- and eukaryotic cells, using enzymes such as β-galactosidase, green fluorescent protein, and several others.

The determination of activity of membrane-transport proteins can be performed according to techniques such as those described in Gennis, R. B., 1989, Pores, Channels and Transporters, in Biomembranes, Molecular Structure and Function, pp. 85-137, 199-234 and 270-322, Springer: Heidelberg.

Example 16

Purification of the Desired Product from Transformed Organisms

Recovery of the desired product from plant material, fungi, algae, ciliates, *C. glutamicum* cells, or other bacterial cells transformed with the nucleic acid sequences described herein, or the supernatant of the above-described cultures can be performed by various methods well known in the art. If the desired product is not secreted from the cells, the cells can be harvested from the culture by low-speed centrifugation, and the cells can be lysed by standard techniques, such as mechanical force or sonification. Organs of plants can be separated mechanically from other tissue or organs. Following homogenization, cellular debris is removed by centrifugation, and the supernatant fraction containing the soluble proteins is retained for further purification of the desired compound. If the product is secreted from desired cells, then the cells are removed from the culture by low-speed centrifugation, and the supernate fraction is retained for further purification.

The supernatant fraction from either purification method is subjected to chromatography with a suitable resin, in which the desired molecule is either retained on a chromatography resin while many of the impurities in the sample are not, or where the impurities are retained by the resin while the sample is not. Such chromatography steps may be repeated as necessary, using the same or different chromatography resins. One skilled in the art would be well-versed in the selection of appropriate chromatography resins and in their most efficacious application for a particular molecule to be purified. The purified product may be concentrated by filtration or ultrafiltration, and stored at a temperature at which the stability of the product is maximized.

There is a wide array of purification methods known to the art and the preceding method of purification is not meant to be limiting. Such purification techniques are described, for example, in Bailey, J. E. & Ollis, 1986, D. F. Biochemical Engineering Fundamentals, McGraw-Hill: New York. Additionally, the identity and purity of the isolated compounds may be assessed by techniques standard in the art. These include high-performance liquid chromatography (HPLC), spectroscopic methods, staining methods, thin layer chromatography, NIRS, enzymatic assay, or microbiologically. Such analysis methods are reviewed in: Patek et al., 1994, Appl. Environ. Microbiol. 60:133-140; Malakhova et al., 1996, Biotekhnologiya 11:27-32; and Schmidt et al., 1998, Bioprocess Engineer. 19:67-70; Ulmann's Encyclopedia of Industrial Chemistry, 1996, vol. A27, VCH: Weinheim, p. 89-90, p. 521-540, p. 540-547, p. 559-566, 575-581, and p. 581-587; Michal, G., 1999, Biochemical Pathways: An Atlas of Biochemistry and Molecular Biology, John Wiley and Sons; Fallon, A. et al., 1987, Applications of HPLC in Biochemistry in: Laboratory Techniques in Biochemistry and Molecular Biology, vol. 17.

Example 17

Salt Tolerance Screening

Salt Test on MS Plate
Seedlings are transferred to filter paper soaked in ½ MS and placed on ½ MS 0.6% agar supplemented with 2 ug/ml benomyl the night before the stress screening. For the stress screening, the filter paper with the seedlings is moved to stacks of sterile filter paper, soaked in 50 mM NaCl, in a petri dish. After two hours, the filter paper with the seedlings is moved to stacks of sterile filter paper, soaked with 200 mM NaCl, in a petri dish. After two hours, the filter paper with the seedlings is moved to stacks of sterile filter paper, soaked in 600 mM NaCl, in a petri dish. After 10 hours, the seedlings are moved to petri dishes containing ½ MS 0.6% agar supplemented with 2 ug/ml benomyl. The seedlings are scored after 5 days, demonstrating that transgene expression confers salt tolerance
Soil Test for Salt Tolerance
Seeds of plants to be tested are sterilized (100% bleach, 0.1% TritonX for five minutes two times and rinsed five times with ddH2O). Seeds are plated on non-selection media (½ MS, 0.6% phytagar, 0.5 g/L MES, 1% sucrose, 2 µg/ml benamyl).

Seeds are allowed to germinate for approximately ten days. At the 4-5 leaf stage, transgenic plants are potted into 5.5 cm diameter pots filled with loosely packed soil (Metromix 360, Scotts) wetted with 1 g/L 20-20-20 fertilizer (Peters Professional, Scotts).

The plants are allowed to grow (22° C., continuous light) for approximately seven days, watering as needed. When the plants are just about to bolt, the water is removed from the tray and the assay is started. To begin the assay, three liters of 100 mM NaCl and ⅛ MS is added to the tray under the pots. To the tray containing the control plants, three liters of ⅛ MS is added. After 10 days, the NaCl treated and the control plants are given water. Ten days later, the plants are photographed.

Example 18

Drought Tolerance Screening

T1 and T2 seedlings are transferred to dry, sterile filter paper in a petri dish and allowed to desiccate for two hours at 80% RH (relative humidity) in a Sanyo Growth Cabinet MLR-350H, micromols$^{-1m2}$ (white light; Philips TL 65W/25 fluorescent tube). The RH is then decreased to 60% and the seedlings are desiccated further for eight hours. Seedlings are then removed and placed on ½ MS 0.6% agar plates supplemented with 2 µg/ml benomyl and scored after five days.

The transgenic plants are screened for their improved drought tolerance demonstrating that transgene expression confers drought tolerance.

Example 19

Freezing Tolerance Screening

Seedlings are moved to petri dishes containing ½ MS 0.6% agar supplemented with 2% sucrose and 2 ug/ml benomyl. After four days, the seedlings are incubated at +4° C. for 1 hour and then covered with shaved ice. The seedlings are then placed in an Environmental Specialist ES2000 Environmental Chamber and incubated for 3.5 hours beginning at −1.0° C. decreasing −1° C. hour. The seedlings are then incubated at −5.0° C. for 24 hours and then allowed to thaw at +5° C. for 12 hours. The water is poured off and the seedlings are scored after 5 days.

The transgenic plants are screened for their improved cold tolerance demonstrating that transgene expression confers cold tolerance.

SEQUENCE LISTING (361 sequences)

SEQ ID NO: 1 - DNA, 1246 bp, Arabidopsis thaliana
  CDS (16)..(1221)
ggggtcgacgaagcaatgagaggacgaagcttgacactctcaagagtaaagctcgagcttgcgagaagaagcatgtctgcaacatccgtaccttcaatggcggattttctcaccaaaaaaccttactctcctccttcttgggcttctcatcttcgtccgcttccttctcacactttctccctcgctcaccttcctactccgatccatcgatggaatcttcctggtcttcctaatggcacagaactctggatcaagcgagatgatttcaccggaatggaattgagtggaaacaaagtacgaaaactcgaattcttaatggcggaagctgttgatcaacacgctgatactgtaatcactatcggcggtattcagagcaatcattgtcgtgctacagccactgcatctaactatcttaatctcaattctcatcttattctccgtacttccaagcttcttgctgatgaagatcctggattggttgggaatctccttgtcgagcgtctcgttggagctaatgttcatctaatctctaaagaagagtattcttccattgggagtgaggctcttactaatgctctgaaagagaaactggaaaaagaaggaaagaaaccctatgttattccagtcggtggatcgaactctttgggaacttggggttatatagaagcagcaagggaaattgaggagcagctgaattatagacccgatgacctgaaatttgatgatattgtggtagcatgtggcagtggtggtacaattgctggtatttcattggggtcttggttgggagctctaaaagccaaggttcatgctttctcggtttgcgatgatcctgattacttctatgactttgtccaagggcttctggatggacttcacgctggtgttaactctcgtgatatcgtcaacatccacaatgccaaaggaaaaggatatgccatgaacacgtcagaggagcttgagtttgtaaagaaagtagcaagttcaactggtgttattcttgatccggtttacagtgggaaagctgcgtatggtttgataaatgagatcaccaaagatcccaaatgttgggagggaaggaagatattgttcatacacactggtgggcttcttgggttgtatgataaggttgatcaaatggcatctctgatgggtaattggtcccggatggatgtttcagaatccgttccaagaaaagatggtgttgggaaaatgttctagcacaacaaaatctgttaattaaccc

SEQ ID NO: 2 - protein, 401 aa, Arabidopsis thaliana
MRGRSLTLSRVKLELARRSMSATSVPSMADFLTKKPYSPPSWASHLRPLPSHTFSLAHLPTPIHRWNLPGLPNGTELWIKRDDFTGMELSGNKVRKLEFLMAEAVDQHADTVITIGGIQSNHCRATATASNYLNLNSHLILRTSKLLADEDPGLVGNLLVERLVGANVHLISKEEYSSIGSEALTNALKEKLEKEGKKPYVIPVGGSNSLGTWGYIEAAREIEEQLNYRPDDLKFDDIVVACGSGGTIAGISLGSWLGALKAKVHAFSVCDDPDYFYDFVQGLLDGLHAGVNSRDIVNIHNAKGKGYAMNTSEELEFVKKVASSTGVILDPVYSGKAAYGLINEITKDPKCWEGRKILFIHTGGLLGLYDKVDQMASLMGNWSRMDVSESVPRKDGVGKMF

SEQ ID NO: 3 - protein, 284 aa, Arabidopsis thaliana
MADFLTKKPYSPPSWASHLRPLPSHTFSLAHLPTPIHRWNLPGLPNGTELWIKRDDFTGMELSGNKVRKLEFLMAEAVDQHADTVITIGGIQSNHCRATATASNYLNLNSHLILRTSKRLADEDPGLVGNLLVERLVGANVHLISKEEYSSIGSEALTNALKEKLEKEGKKPYVIPVGGSNSLGTWGYIEAAREIEEQLNSRPDDLKFDDIVVACGSGGTIAGISLGSWLGALKAKVHAFSVCDDPDYFYDFVQGLLDGLHAGVNSRDIVNIHNAKGKGYAMNT

SEQ ID NO: 4 - DNA, 1083 bp, Escherichia coli
  CDS (1)..(1083)
atgacaaaaaagggcgctttcactagcgccttttttatttacgcgttttcagcgtgcataataagaaaatcacaacaacacacatcggaggctgttatgccactgcataatttaacccgttttccacggctggagtttatcggcgcgccaacgccgctcgaatatctgccgcgcttttctgattatctaggacgggaaattttcatcaaacgggatgacgtcacccccatggcaatgggcggcaataaattacgtaagctggaatttctcgcggcagatgctctgcgtgaaggtgccgatacgctgattactgccggggcgatccagtctaaccatgtgcggcagactgccgcagtcgctgccaaactcggtctgcactgcgtggcgctgctggaaaatcctattggcacaaccgcagaaaactatttaaccaacggcaatcgcttgttgctggatctgttcaatacccagattgaaatgtgcgacgcactgaccgatcccaatgcccaactggaagagctggcgacgcgagtcgaagcacaaggctttcgcccgtatgtcattccggttggcggttctaatgctcttggcgcgctaggttatgtggagagtgcgctggaaatcgcgcaacagtgtgaaggggcggttaatatttcatcggtggtagtcgcatcgggcagtgccggaactcacgccggactggctgttgggctggaacacctgatgcctgaaagcgaactgattggcgtgaccgtgtcgcgttccgttgccgatcaattgccgaaagtggttaacctacaacaggcgattgcgaaagaactggagctgaccgcatcagcggaaattttactctgggatgactattttgcacctggctacggcgtgccgaacgacgaaggcatggaagcagtgaaattgctggcgcggctggaaggcattctgcttgatcctgtgtataccggaaaagcgatggcggggctgattgacggtatcagtcagaaacgcttcaaagatgaagggccgattctgtttattcataccggcggtgcgcctgcgctgttcgcctatcatccccacgtttag

SEQ ID NO: 5 - protein, 360 aa, Escherichia coli
MTKKGAFTSAFFIYAFSACIIRKSQQHTSEAVMPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTGGAPALFAYHPHV

SEQ ID NO: 6 - DNA, 893 bp, Oryza sativa
  CDS (79)..(702)
gctgctgccccgacgcgctgctcgctgccccactctctccccattcccctccacgccgccgccgccgccgccgcgtggatggccggagtttccgccgcctccgccgccgggaagatcgggagcttcctctccaagaggccgtacgcgccgccgtcctgggcctcgcacctgtcccccgccccctcgcagaccttctcgctcggccatttcccgacgccgatccacaagtggaatctgcccaatttgccgaatggcacggaggtgtggatcaagcgagacgacatctcaggcatgcagttgagcgggaacaaggtccggaagctcgagttcctgatggcagatgccgtcgcgcagggcgctgactgcgttataactgtaggtggcatccagagcaatcactgccgtgccaccgcagtggctgcaaagtatataaatcttgattgttatctgatactgcgcacatccaagcttcttgtggataaggaccctggtttggttgggaatctccttgttgagagattggtgggagcgcatattgatcttgtttcaaaagaagaatatggaaaaattggcagtgtggctttagcggacttgctgaaaaagaagcttttggaagaaggccgaaaaccatatgttattcctgttggtggatcaaactctctaggaacttggtattgttttctgttcaatcctaactattgaaccatttttgcattttcaatttctttgtgcgtttatagcatactttgaatattcctcagggactattattattcatggattggtgtttgccatcagtctatcagaaaagaagagattagtttgtatttgaataaacattagggcatcacttttttttggcaaatttctaatggtcaatatactatgttgga

SEQ ID NO: 7 - protein, 207 aa, Oryza sativa
MAGVSAASAAGKIGSFLSKRPYAPPSWASHLSPAPSQTFSLGHFPTPIHKWNLPNLPNGTEVWIKRDDISGMQLSGNKVRKLEFLMADAVAQGADCVITVGGIQSNHCRATAVAAKYINLDCYLILRTSKLLVDKDPGLVGNLLVERLVGAHIDLVSKEEYGKIGSVALADLLKKKLLEEGRKPYVIPVGGSNSLGTWYCFLFNPNY

SEQ ID NO: 8 - DNA, 1455 bp, Zea mays
  CDS (85)..(1272)
cattgggaacctcgagtccggacggcgactctcccactcctctgtcgcttccgccgacacctgagtcttgtcgctgccgccgggatggccggagtcaccgccaccgggatggccggagttcccgccaccttctcctcagccaccgctcagatcgggggcttcctctcgaagaagccttacgcgccgccgttgtgggccacgcacctctcccccatgccttgccataccttctcgctcggccatttcccaacaccgattcacaagtggaatctgcccaatttgccggaaggaacggaagtgtggatcaagcgagacgatttatcaggcatgcagttgagtggaaacaaggtccggaagctggagttcttgatggcagatgccgtagcacaaggcgcagactgcgttattactgttgggggtatacagagtaaccactgccgtgccacagccgtggctgctaagtatctcaatcttgattgctacctgatactacgtacctccaagcttcttgtggataaggaccctggtttggttggcaatcttcttgtcgagagactagttggggcacacgttgatcttgtgtcaaaagaagaatatggaaaaattggtagtgtggctttagctgacctgctgaaaaaaaggcttctggaagaagggaggaagccgtatgtgattcctgttggtggatcaaactcattgggaacttggggatatattgaggcaataagggagattgagcagcaaattcagcaatcttctgatgttcagtttgatgatattgttgttgcatgtggcagtggtggaaccattgctggccttgctttaggatccagattgagcagcttaaatacaaaagttcatgcattctctgtttgtgatgaccctgaatacttctatgactatgtccaaggcctgattgatggacttaattctggtttggattcacatgatatagttagcatcgaaaatgctaaggggttaggctatgccatgaacacagctgaggagcttaagtttgtcaaagacatagctgcatcaacaggcattgtccttgatccagtctacagtgggaaggcggtttatggtttgctaaaagacatggctggcaatccagccaaatggaaaggtcgaaaagttctgtttatccacacaggtggtcttcttgggttgtatgataaggctgaccagttgtcatctttggctgggagctggcgcagaatggatcttgaagattctgttccacgcaaagatggcactggtaagatgttctgatcagtatggtccatgtgattccatgatggctcattcttgcaaacattgtatccattacagagttattactcttaaatttgtgcaagaaaatgcagaatagatggttcacattgtatagaacactgatgcaatttaagaataaagcacatctttctgccctttaaaaaaaaaaaacaacaaaaa

SEQ ID NO: 9 - protein, 395 aa, Zea mays
MAGVTATGMAGVPATFSSATAQIGGFLSKKPYAPPLWATHLSPMPCHTFSLGHFPTPIHKWNLPNLPEGTEVWIKRDDLSGMQLSGNKVRKLEFLMADAVAQGADCVITVGGIQSNHCRATAVAAKYLNLDCYLILRTSKLLVDKDPGLVGNLLVERLVGAHVDLVSKEEYGKIGSVALADLLKKRLLEEGRKPYVIPVGGSNSLGTWGYIEAIREIEQQIQQSSDVQFDDIVVACGSGGTIAGLALGSRLSSLNTKVHAFSVCDDPEYFYDYVQGLIDGLNSGLDSHDIVSIENAKGLGYAMNTAEELKFVKDIAASTGIVLDPVYSGKAVYGLLKDMAGNPAKWKGRKVLFIHTGGLLGLYDKADQLSSLAGSWRRMDLEDSVPRKDGTGKMF

SEQ ID NO: 10 - DNA, 987 bp, Escherichia coli
  Escherichia coli W3110
  CDS (1)..(987): transl_table=11
atgccactgcataatttaacccgttttccacggctggagtttatcggcgcgccaacgccgctcgaatatctgccgcgcttttctgattatctaggacgggaaattttcatcaaacgggatgacgtcacccccatggcaatgggcggcaataaattacgtaagctggaatttctcgcggcagatgctctgcgtgaaggtgccgatacgctgattactgccggggcgatccagtctaaccatgtgcggcagactgccgcagtcgctgccaaactcggtctgcactgcgtggcgctgctggaaaatcctattggcacaaccgcagaaaactatttaaccaacggcaatcgcttgttgctggatctgttcaatacccagattgaaatgtgcgacgcactgaccgatcccaatgcccaactggaagagctggcgacgcgagtcgaagcacaaggctttcgcccgtatgtcattccggttggcggttctaatgctcttggcgcgctaggttatgtggagagtgcgctggaaatcgcgcaacagtgtgaaggggcggttaatatttcatcggtggtagtcgcatcgggcagtgccggaactcacgccggactggctgttgggctggaacacctgatgcctgaaagcgaactgattggcgtgaccgtgtcgcgttccgttgccgatcaattgccgaaagtggttaacctacaacaggcgattgcgaaagaactggagctgaccgcatcagcggaaattttactctgggatgactattttgcacctggctacggcgtgccgaacgacgaaggcatggaagcagtgaaattgctggcgcggctggaaggcattctgcttgatcctgtgtataccggaaaagcgatggcggggctgattgacggtatcagtcagaaacgcttcaaagatgaagggccgattctgtttattcataccggcggtgcgcctgcgctgttcgcctatcatccccacgtttag

SEQ ID NO: 11 - protein, 328 aa, Escherichia coli
  Escherichia coli W3110
MPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTGGAPALFAYHPHV

SEQ ID NO: 12 - DNA, 987 bp, Pyrococcus horikoshii
  Pyrococcus horikoshii OT3
  CDS (1)..(987): transl_table=11
gtggtgaatatgcatccgaagatctttgctcttcttgctaaatttccaagggttgagttaatcccctgggagacacccatacagtaccttcctaacataagtagagaaataggagccgacgtatatatcaaaagggatgatctaactggtctcggaattggggggaataaaataaggaagctcgaatatctcctgggtgacgctctctctaaaggagcagacgtcgtaataactgtgggagcagtgcattccaatcatgcattcgttactggactagccgccaagaaacttgggcttgatgcaatcctagttttaagggggaaggaagagctgaaaggaaactaccttctagataagatcatgggcatcgaaacaagggtgtatgatgcaaaggactcctttgagctcatgaagtatgctgaggagatcgcggaggaattgaaaagagagggtaggaagccctatgttattccaccgggaggagcatccccaatagggacgcttggttacgttagggccgttggagagattgcaacgcagagcgaagttaaattcgatagcatagttgtagcagctggaagtggaggtacgcttgcaggattatccctgggcttgtcgatccttaatgaagatattagacccgtaggaatcgcagttggtagattcggtgaagtaatgactagtaagctggacaacttaattaaagaagctgcggagttacttggagtaaaggttgaggtaaggccggagttatacgactacagctttggagagtacggtaagataaccggtgaagttgctcaaattataaggaaagttggaacgagggaaggaataatactggatcccgtatatacggggaaggcattctatgggctcgttgatctagctaggaaaggggagttgggggagaagattctctttatccatactggagggatatcgggaacgttccactatggtgacaaacttttgtcactactttag

SEQ ID NO: 13 - protein, 328 aa, Pyrococcus horikoshii
  Pyrococcus horikoshii OT3
MVNMHPKIFALLAKFPRVELIPWETPIQYLPNISREIGADVYIKRDDLTGLGIGGNKIRKLEYLLGDALSKGADVVITVGAVHSNHAFVTGLAAKKLGLDAILVLRGKEELKGNYLLDKIMGIETRVYDAKDSFELMKYAEEIAEELKREGRKPYVIPPGGASPIGTLGYVRAVGEIATQSEVKFDSIVVAAGSGGTLAGLSLGLSILNEDIRPVGIAVGRFGEVMTSKLDNLIKEAAELLGVKVEVRPELYDYSFGEYGKITGEVAQIIRKVGTREGIILDPVYTGKAFYGLVDLARKGELGEKILFIHTGGISGTFHYGDKLLSLL

SEQ ID NO: 14 - DNA, 876 bp, Campylobacter jejuni
  Campylobacter jejuni subsp. jejuni NCTC 11168
  CDS (1)..(876): transl_table=11
ttgaatttcattaaaacaattagtcctatacaaaaaatcaattttaacggatttgaattttatattaaaagagatgatttattaggggaaattaatggaaataaagctaggaaacttgctttttatatccatcaaagatatcctaaaaatcaatcttttgtaagttatggaggaagccaaagtaatgctttggcggcattaagtatttttgctaaacaaagatcatataagcttgtttttgcttgtgaaaaaatttctacttttcttaagaataatccttgtggaaactatgctttagctttagaaaatggtgttgattttgtagaaaatatccattctttatccttaaagcaatttgctttgtctttgtgtaaaaaagatgatgtttttatagaacaaggtatagctaatttagaagctcaatatggctatatggaacttgctcaagaaattcaaatgcaaagtcaaagtttaaagcttgattttgatatttttttaccttcgggtacaggcacttcggcagcttttttggcaaagtattctaaatttaaagtatttacttgcgcttgtgtaggtgatattaaatatcttaaaaaacaaattttaacattagatccaagctatgatttttcaaatttagaatttttaacaagtgataaaaaatatcactttgctaagccgtataaagaattttatgagctttatatggatttaaagttaaagtgcaatatagaatttgacttgttgtatgatattttaggattaagtatagcattaaaacaagagtggaaaaaaccattgctttatatacatcaaggtggaattttaggaaattccactatgttagagagatataaatttaaaaaatcagtttaa

SEQ ID NO: 15 - protein, 291 aa, Campylobacter jejuni
  Campylobacter jejuni subsp. jejuni NCTC 11168
MNFIKTISPIQKINFNGFEFYIKRDDLLGEINGNKARKLAFYIHQRYPKNQSFVSYGGSQSNALAALSIFAKQRSYKLVFACEKISTFLKNNPCGNYALALENGVDFVENIHSLSLKQFALSLCKKDDVFIEQGIANLEAQYGYMELAQEIQMQSQSLKLDFDIFLPSGTGTSAAFLAKYSKFKVFTCACVGDIKYLKKQILTLDPSYDFSNLEFLTSDKKYHFAKPYKEFYELYMDLKLKCNIEFDLLYDILGLSIALKQEWKKPLLYIHQGGILGNSTMLERYKFKKSV

SEQ ID NO: 16 - DNA, 1083 bp, Escherichia coli
  Escherichia coli O157:H7 EDL933
  CDS (1)..(1083): transl_table=11
atgacaaaaaagggcgctttcactagcgccttttttatttacgcgttttcagcgtgcataatgagaaaatcacaacaacacacatcggaggctgttatgccactgcataatttaacccgttttccacggctggagtttatcggcgcgccaacgccgctcgaatatctgccgcgcttttctgattatctaggacgggaaattttcatcaaacgggatgacgtcacccccatggcaatgggcggcaataaattacgtaagctagaatttctcgcggcagatgctctgcgtgaaggtgccgatacgctgattactgccggggcgatccagtctaaccatgtgcggcagactgccgcagtcgctgccaaactcggtctgcactgcgtggcgctgctggaaaatcctattggcacaaccgcagaaaactatttaaccaacggcaatcgcttgttgctggatctgttcaatacccagattgaaatgtgcgacgcactgaccgatcccaatgcccaactggaagagctggcgacgcgagtcgaagcacaaggctttcgcccgtatgtcattccggttggcggttctaatgctcttggcgcgctaggttatgtggagagtgcgctggaaatcgcgcaacagtgtgaaggggcggttaatatttcatcggtggtagtcgcatcgggcagtgccggaactcacgccggactggctgttgggctggaacacctgatgcctgaaagcgaactgattggcgtgaccgtgtcgcgttccgttgccgatcaattgccgaaagtggttaacctacaacaggcgattgcgaaagaactggagctgaccgcatcagtggaaattttactctgggatgactattttgcacctggctacggcgtgccgaacgacgaaggcatggaagcagtgaaattgctggcgcggctggaaggcattctgcttgatcctgtgtataccggaaaagcgatggcgggtctgattgacggtatcagtcagaaacgcttcaaagatgaagggccgattctgtttattcataccggcggcgcgcctgcgctgttcgcctatcatccccacgtttag

SEQ ID NO: 17 - protein, 360 aa, Escherichia coli
  Escherichia coli O157:H7 EDL933
MTKKGAFTSAFFIYAFSACIMRKSQQHTSEAVMPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASVEILLWDDYFAPGYGVPNDEGMEAVKLLARLEGILLDPVYTGKAMAGLIDGISQKRFKDEGPILFIHTGGAPALFAYHPHV

SEQ ID NO: 18 - DNA, 1002 bp, Caulobacter crescentus
  Caulobacter crescentus CB15
  CDS (1)..(1002): transl_table=11
atgcatctcgctcgctttcctcgcgcccgcttcgcccacctgcccacgcccctggaacccatgccgcgcctcggcgcggagctggggatcgacctctgggtcaagcgcgacgactgcaccggcctggccggcggcggcaacaagacccgcaagctggagttcctcctcggcgaggccctgatccagggcgccgacaccctggtgacccagggcgcggttcagtccaatcacgtgcgccagaccatcgctgccggcgcgcgctttggcctcaagaccgaggtgatcctcgaagagcgcaccggctccaaggccagcgactatatgggcaacggcaacgtgctgctcgacaagctgatgggcgcgtcgctgcgctatgtgccgggcggcacggacatggtcgccgagctcgacagcactgcggagaacgttcgtcagcgcgggggtaagccctacgtgatccccggcggcggctcgaacacggtgggcgcgctcggctatgtcgattgcgcgcgcgagctcgtcgtccaggccgaccagatggacttgaagatcgatcgcctggtcacggcgaccggcagcgccggcacgcacgccggcctggtcgccggcttcgccgcgctgtccgtcgatatcccgatcctgggcttcggcgtccgcgcgcccaagcccaagcaggaagagaacgtctataaccttgccgtcgccacggccgagacgatcggcgctggtggccgggtcaggcgcgaagcggtcgtcgccgactgcgactatgtcggtgagggctacggcctcgtggaccaaggcgtgatcgacgcgctggccctggccgcccgcaccgaaggtctgctgctggatcccgtctattcgggcaaggcgatgaaggggctgatcgaccaggcccgcaaaggcgcgttcaagggcgagcgggtcgtcttcctgcacaccggcggcgcccagggcctgttcggctatcagacggtgctcgagccggcgctgggatag

SEQ ID NO: 19 - protein, 333 aa, Caulobacter crescentus
  Caulobacter crescentus CB15
MHLARFPRARFAHLPTPLEPMPRLGAELGIDLWVKRDDCTGLAGGGNKTRKLEFLLGEALIQGADTLVTQGAVQSNHVRQTIAAGARFGLKTEVILEERTGSKASDYMGNGNVLLDKLMGASLRYVPGGTDMVAELDSTAENVRQRGGKPYVIPGGGSNTVGALGYVDCARELVVQADQMDLKIDRLVTATGSAGTHAGLVAGFAALSVDIPILGFGVRAPKPKQEENVYNLAVATAETIGAGGRVRREAVVADCDYVGEGYGLVDQGVIDALALAARTEGLLLDPVYSGKAMKGLIDQARKGAFKGERVVFLHTGGAQGLFGYQTVLEPALG

SEQ ID NO: 20 - DNA, 987 bp, Salmonella enterica
  Salmonella enterica subsp. enterica serovar Typhi str. CT18
  CDS (1)..(987): transl_table=11
atgccactacatcacttaacgcgctttcctcgcctggagcttattggcgcgccgaccccgctcgaatacctgccgcgattgtctgattatcttggccgtgagatttacattaagcgcgatgacgttacgcccattgcaatgggcggcaataaactgcgtaagctggagtttctagtggccgacgcgctgcgagaaggggcggatacgctgataaccgcaggggcgattcagtcaaaccatgtccgtcagacggcggcggttgcggccaaattggggctgcattgcgtcgccttgctggaaaatccaatcggtaccaccgcggaaaattacctgacgaatggtaatcgcctgttactggatttatttaatacacaaattgagatgtgcgatgcgctaaccgatccggatgcgcagctgcaaacgctggcgacgcgcattgaagcgcaagggttcaggccctatgtgattccggtcggcggctccagcgcgttgggcgcaatgggatacgtagagagcgccctggagatcgtccagcagtgtgaagaggtcgtcgggctctcttcggtggtggtggcctccggcagcgccggaacgcacgccgggttagctgtcgggctggaacatctgatgccggatgtcgaactgattggcgtgaccgtttcacgttctgtcgccgagcagaaacccaaagtgattgccttgcagcaggctattgccggccagctggcgctgacggcgacggcggatattcatttatgggatgactattttgccccgggttacggcgtgccaaatgacgcggggatggaggcggtgaaactgctggcgaacctggagggggtgctgctggatccggtatataccggtaaagcgatggcgggtctgatagatggcatcagccagaaacgctttaacgatgacgggccgattctctttattcataccggtggggcgcctgcgctgtttgcctaccatcctcatgtataa

SEQ ID NO: 21 - protein, 328 aa, Salmonella enterica
  Salmonella enterica subsp. enterica serovar Typhi str. CT18
MPLHHLTRFPRLELIGAPTPLEYLPRLSDYLGREIYIKRDDVTPIAMGGNKLRKLEFLVADALREGADTLITAGAIQSNHVRQTAAVAAKLGLHCVALLENPIGTTAENYLTNGNRLLLDLFNTQIEMCDALTDPDAQLQTLATRIEAQGFRPYVIPVGGSSALGAMGYVESALEIVQQCEEVVGLSSVVVASGSAGTHAGLAVGLEHLMPDVELIGVTVSRSVAEQKPKVIALQQAIAGQLALTATADIHLWDDYFAPGYGVPNDAGMEAVKLLANLEGVLLDPVYTGKAMAGLIDGISQKRFNDDGPILFIHTGGAPALFAYHPHV

SEQ ID NO: 22 - DNA, 987 bp, Salmonella typhimurium
  Salmonella typhimurium LT2
  CDS (1)..(987): transl_table=11
atgccactacatcacttaacgcgcttccctcgcctggagtttatcggcgcgccgaccccgctcgaatacctgccgcgattgtctgattatcttggccgtgagatttacattaagcgcgatgacgttacgcccattgcaatgggcggcaataaactgcgcaagctggagtttttggtggccgacgcgctgcgagaaggggcggatacgctgataaccgcaggggcgattcagtcgaaccatgtccgtcagacggcggcagtcgcggccaaattgggactgcattgcgtcgccttgctggaaaatccaatcggtaccaccgcggaaaattacctgacgaatggtaatcgcctgttactggatttatttaatacgcaaattgagatgtgcgatgcgctaaccgatccggatgcgcagctgcaaacgctggcgacgcgcattgaagcgcaagggttcaggccctatgtgattccggtcggcggttccagcgcgctgggggcaatgggatacgtagagagcgccctggaaatcgcccagcagtgtgaagaggtcgtcgggctctcttcggtggtggtggcctccggcagcgccggaacgcacgccgggttagctgtcgggctggaacatctgatgccggatgtcgaactgattggcgtgaccgtttcacgttctgtcgccgagcagaaacccaaagtgattgccttgcagcaggctattgccggtcagctggcgctgacggcgacggcggatatccatttatgggatgactattttgccccgggttacggcgtgccaaatgacgcggggatggaggcggtgaaactgctggcgagcctggagggggtgctgctggatccggtatataccggtaaagcgatggcgggtctgatagacggcatcagccagaaacgctttaacgatgacgggccgattctctttattcacaccggtggggcgcctgcgctgtttgcctaccatcctcatgtataa

SEQ ID NO: 23 - protein, 328 aa, Salmonella typhimurium
  Salmonella typhimurium LT2
MPLHHLTRFPRLEFIGAPTPLEYLPRLSDYLGREIYIKRDDVTPIAMGGNKLRKLEFLVADALREGADTLITAGAIQSNHVRQTAAVAAKLGLHCVALLENPIGTTAENYLTNGNRLLLDLFNTQIEMCDALTDPDAQLQTLATRIEAQGFRPYVIPVGGSSALGAMGYVESALEIAQQCEEVVGLSSVVVASGSAGTHAGLAVGLEHLMPDVELIGVTVSRSVAEQKPKVIALQQAIAGQLALTATADIHLWDDYFAPGYGVPNDAGMEAVKLLASLEGVLLDPVYTGKAMAGLIDGISQKRFNDDGPILFIHTGGAPALFAYHPHV

SEQ ID NO: 24 - DNA, 948 bp, Nostoc sp.
  Nostoc sp. PCC 7120
  CDS (1)..(948): transl_table=11
atgtcattgacctttgttcctccgccaatacaaaaaatcaatagtgagattgctaataatgctggtgtagaaatttatgtattacgccttgatttaatgcacccgtgggtaaacggtaataagtggtacaagctgaaatacaatctcttagaagctaaggagaaaagttacacaaaattactcacctttggtggtgcatattctaatcacatcttcgctactgccgcagcaggtaatcttttaggattccagactattggtataattcgtggggaagaaaccttacccttaaatcccacactaagttttgcaacgcaacaaggtatgcagcttgtctatgtggacagggaaacctatcgacaacgaaacagcaccacattacacacagacctaaggaaacgctttggtgaggtatttatcattccagaaggtggtagtaatttgaatggtgtgcgtggttgtctagaaataataagtgccgcaacacaagtatttgatattgtttgtgtagcttgtggtacagccaccaccctagcaggtatcgctctggcactggaacctcagcaacgtgtgattggttttcctgtcttaaaaaatgggggttttttagcacaggatattgctcagttaatgaagaattatgtcgcggcggggttgcccatttcatctagttctcccgcctcttgggaattagtttgcgattaccattttggcggttacgccaaggtgaaagatgatctcatactgttcagtcaccagtttacccaaagctacggcgtacctcttgattacgtgtatacagcgaaaatgttttacggcgtaatggacttgttaaagcaaagatattttacgaaaggtgatggtctccgaccgaccgtaggtcatcgtatcttaatgattcacacgggtggcttacagggaaatatcgggatgagtgaacgattgtaa

SEQ ID NO: 25 - protein, 315 aa, Nostoc sp.
  Nostoc sp. PCC 7120
MSLTFVPPPIQKINSEIANNAGVEIYVLRLDLMHPWVNGNKWYKLKYNLLEAKEKSYTKLLTFGGAYSNHIFATAAAGNLLGFQTIGIIRGEETLPLNPTLSFATQQGMQLVYVDRETYRQRNSTTLHTDLRKRFGEVFIIPEGGSNLNGVRGCLEIISAATQVFDIVCVACGTATTLAGIALALEPQQRVIGFPVLKNGGFLAQDIAQLMKNYVAAGLPISSSSPASWELVCDYHFGGYAKVKDDLILFSHQFTQSYGVPLDYVYTAKMFYGVMDLLKQRYFTKGDGLRPTVGHRILMIHTGGLQGNIGMSERL

SEQ ID NO: 26 - DNA, 1065 bp, Pyrococcus furiosus
  Pyrococcus furiosus DSM 3638
  CDS (1)..(1065): transl_table=11
gtggatgggagcggtggagggttcccaccctcgggcgtgcccgccgccgctagaaattttatatgggtggtaactatgcatccaaaagttcaatctcttctatcaaaattccctagagttgaattaatcccatgggaaacaccaattcaatatttgcctaacataagcaaacttgtaggggctgatatttacgtcaaaagggacgacctcacagggcttggaatcggagggaacaaaattagaaaactggaatacctgctgggagatgcaataataagaaaagccgatgtaataataactgtaggtgctgtacactcaaaccacgcgtttgtaacaggcttggcagcaaaaaagttagggtttgatgtagttctagttttaagaggaaaggaagaattaaggggaaactacctgctggacaaaatcatggggatagaaacgagagtttatgaagctaaagattcttttgaacttatgaaatatgctgaggaagttgccaaagaactagaagaaaagggaagaaagccatatataatacctgtcggaggagcttctccggtcggaacattgggttatgttagagctagtggagagatcgcagagcagggaaatagaattggagttaactttgacagcattgtcgttgcaacgggtagcggaggtacactagctggactatctgtaggattggcaattttaaggaaggaaacaagggcaattggtatggcagttggaaagtttggagagacgatggttaataaagtggaagaacttgcaaaagcaactggagagttcatcggagtgaaaaatttaaagctaaaaattgagctctatgattacagctttggagaatatggaaaaataacaagggaagttgcagaaaccattaggctagtcggaacaaaagaaggggtaatcttagaccctgtctatactggaaaagcattctacggattacttgatctcgctaaaaaaggagaattaggggagaaaatactgtttattcacaccggaggaatctctggaacattccattatggggacaagatactctcattcctttag

SEQ ID NO: 27 - protein, 354 aa, Pyrococcus furiosus
  Pyrococcus furiosus DSM 3638
MDGSGGGFPPSGVPAAARNFIWVVTMHPKVQSLLSKFPRVELIPWETPIQYLPNISKLVGADIYVKRDDLTGLGIGGNKIRKLEYLLGDAIIRKADVIITVGAVHSNHAFVTGLAAKKLGFDVVLVLRGKEELRGNYLLDKIMGIETRVYEAKDSFELMKYAEEVAKELEEKGRKPYIIPVGGASPVGTLGYVRASGEIAEQGNRIGVNFDSIVVATGSGGTLAGLSVGLAILRKETRAIGMAVGKFGETMVNKVEELAKATGEFIGVKNLKLKIELYDYSFGEYGKITREVAETIRLVGTKEGVILDPVYTGKAFYGLLDLAKKGELGEKILFIHTGGISGTFHYGDKILSFL

SEQ ID NO: 28 - DNA, 1020 bp, Yersinia pestis
  Yersinia pestis KIM
  CDS (1)..(1020): transl_table=11
atgattcatcaattccttggggggcacgtgacgcttcaacaaaaactgacgcaattcccgcgtctcgatctggtcggtaatgcgacgccattagaaaaactgtctcgtctatctgattatctgggacgtgaaatttacattaaacgtgatgatgtcacgcctgtggcgcttggcgggaataaactgcgcaagctagaattcttagccgcagatgccttgagacagggagccgatacgctggttacggctggtgctattcaatctaatcatgtccgccaaaccgccgccgtggccgcgaaactggggctgcattgcgttgcgctgttggaaaaccccattggtactgagcaggcaaactatctgaccaatgggaaccggctgttactggacctattcaatgttgatgttgtgatgtgtgaggcattgaacgatccaaatcagcaattagcagaattggctacccgcgtggaagcgcagggtttccgcccatatgtggtaccgattggcggttctaatgccttgggcgcgctgggttatgtgcagtgctcactggaaattgctgctcaagccgcgggcaatgttgcgtttagttcggtcgtcgtggcctctggcagtgcgggaacacatgcaggattggcggttggtctacagcagttgttacccgatgcggaattaatcggtgtgacggtatcacgtagtgccgatgaacagcggcctaaagtggcacagattcaacaagcgttggcgacatcattagggatgacggacccattggcaaaaatcaccttgtgggatagttattttgccccgcaatatgggatgccaaacgaagaggggatagcggctattaagctcttggcaagactggaaggaatattgttggaccctgtgtataccggtaaggcgatggcgggcttacttgatggtattgaacagcaaaaattctgcgacaaagggccaattttatttatccacactggcggggcacctgcgctgtttgcttatcatccgcaggtgtag

SEQ ID NO: 29 - protein, 339 aa, Yersinia pestis
  Yersinia pestis KIM
MIHQFLGGHVTLQQKLTQFPRLDLVGNATPLEKLSRLSDYLGREIYIKRDDVTPVALGGNKLRKLEFLAADALRQGADTLVTAGAIQSNHVRQTAAVAAKLGLHCVALLENPIGTEQANYLTNGNRLLLDLFNVDVVMCEALNDPNQQLAELATRVEAQGFRPYVVPIGGSNALGALGYVQCSLEIAAQAAGNVAFSSVVVASGSAGTHAGLAVGLQQLLPDAELIGVTVSRSADEQRPKVAQIQQALATSLGMTDPLAKITLWDSYFAPQYGMPNEEGIAAIKLLARLEGILLDPVYTGKAMAGLLDGIEQQKFCDKGPILFIHTGGAPALFAYHPQV

SEQ ID NO: 30 - DNA, 1083 bp, Shigella flexneri
  Shigella flexneri 2a str. 301
  CDS (1)..(1083): transl_table=11
atgacaaaaaagggcgctttcactagcgccttttttatttacgcgttttcagcgtgcataataagaaaatcacaacaacacacatcggaggctgttatgccactgcataatttaacccgttttccacggttggagtttatcggcgcgccaacgccgctcgaatatctgccgcgcttttctgattatcttggacgggaaattttcatcaaacgggatgaggtcacccccatggcaatgggcggcaataaattacgtaagctggaatttctcgcggcagatgccctgcgcgaaggtgccgatacgctgattactgccggcgcgatccagtctaaccatgtgcgccagactgccgcagtcgcggcgaaactcggtctgcactgcgtggcgctgctggaaaatcctattggcacaaccgcagaaaactatttaaccaacggcaatcgtttgttgctggatctgttcaatacccagattgaaatgtgcgacgcactgaccgatcccaatgcccaactggaagaactggcgacgcgagtcgaagcacaaggctttcgcccgtatgtcattccggttggcggttctaatgctcttggcgcgctaggttatgtggagagtgcgctggaaatcgcgcaacagtgtgaaggggcggttaatatttcgtcggtggtagtcgcatcgggcagtgccggaactcacgccggactggctgttgggctggaacacctgatgcctgaaagcgaactgattggcgtgaccgtgtcgcgttccgttgccgatcaattgccgaaagtggttaacctacaacaggcgattgcgaaagaactggagctgaccgcatcagcggaaattttactctgggatgactattttgcacctggctacggcgtgccgaacgacgaaggcatggaagcagtgaaattgctggcgcgtctggaaggcattctgcttgatcctgtgtataccggaaaagcgatggcggggctgattgacggtatcagtcagaaacgcttcaaagatgaagggccgattctgtttattcataccggcggcgcgcctgcgctgttcgcctatcatccccacgtttag

SEQ ID NO: 31 - protein, 360 aa, Shigella flexneri
  Shigella flexneri 2a str. 301
MTKKGAFTSAFFIYAFSACIIRKSQQHTSEAVMPLHNLTRFPRLEFIGAPTPLEYLPRFSDYLGREIFIKRDEVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTGGAPALFAYHPHV

SEQ ID NO: 32 - DNA, 894 bp, Pseudomonas putida
  Pseudomonas putida KT2440
  CDS (1)..(894): transl_table=11
atgcatgtattcgacctcccccaagccccgctgcattttctggacttgccctggctggaacaagcccaggtccaggccgccactctgcgcctggacctgatcgacccgctgatcagcggcaacaagtggttcaaactacgccaccacctgcaacaggccggcgccagcaacgctccaggcctgatcagcctcggcggtaaccattccaaccatctgcacgccttggccgctgccggcaagcgtttcggcttcgccaccgtcggcctgttacgcggccatgcccaggacacgccaaccgtgcgtgacctgcaggcgctgggcatggaactgcattggctaggctacggcggctaccgtgcacgcaacgaacccggcttctgggaaccttggcaagcgcgctatccaggctggcactgcatccccgaagggggcggcgggctggccggtgcgcagggctgcgcactgatcatgcagcaggcgcgcgcgcagatcgcgggattgggctggtcagaccatgacgcctggtggctggctgccggaacggggactaccttggccggccttgtactggccgaggcgggtgcacatgccgtgcatggcgcgctggcagtgcccagggatcatggggtgccagagacggtggcagcactggccggcacgcacggctaccagctacacgacgcctgccgtggcggtttcggaaaattcgacgatgagctactgaccttcatcgccgactgcgagcggcgcactggcgtgccgctcgaagccctctataccggcaaggctctgctggccttgcgtgatcaggttgctgccgggctgttcaagcccggcagccgcctgatcttcgtacacacgggtggcctgcaggggcgacgcggttacttgtaa

SEQ ID NO: 33 - protein, 297 aa, Pseudomonas putida
  Pseudomonas putida KT2440
MHVFDLPQAPLHFLDLPWLEQAQVQAATLRLDLIDPLISGNKWFKLRHHLQQAGASNAPGLISLGGNHSNHLHALAAAGKRFGFATVGLLRGHAQDTPTVRDLQALGMELHWLGYGGYRARNEPGFWEPWQARYPGWHCIPEGGGGLAGAQGCALIMQQARAQIAGLGWSDHDAWWLAAGTGTTLAGLVLAEAGAHAVHGALAVPRDHGVPETVAALAGTHGYQLHDACRGGFGKFDDELLTFIADCERRTGVPLEALYTGKALLALRDQVAAGLFKPGSRLIFVHTGGLQGRRGYL

SEQ ID NO: 34 - DNA, 987 bp, Escherichia coli
  Escherichia coli CFT073
  CDS (1)..(987): transl_table=11
atgccactgcataatttaacccgttttccacggctggagtttatcggcgcgccaacgccgctcgaatatctgccgcgcttttctgattatcttggacgggaaattttcatcaaacgggatgacgtcactcccatggcaatgggcggcaataaattacgtaagctggaatttctcgcggcagatgctctgcgtgaaggtgccgatacgctgattactgccggggcgatccagtctaaccatgtgcgccagactgccgcagttgcggcgaaactcggtctgcactgcgtggcgctgctggaaaatcctattggcacaaccgcagaaaactatttaaccaacggcaatcgtttgttgctggatctgttcaatacccagattgaaatgtgcgacgcactgaccgatcccaatgcccaactggaagtgctggcgacgcgagtcgaagcacaaggctttcgcccgtatgtcattccggttggcggttctaatgctttgggcgcgctgggttatgtggagagtgcgctggaaattgcgcaacagtgtgaaggggcagttaatatttcgtcggtggtggtcgcgtcgggcagtgccggaactcacgccggactggctgttgggctggaacacctgatgcctgaaagcgaactgattggcgtgactgtgtcgcgttctgttgccgatcaattgccgaaagtggttaacctccaacaggcgattgcgaaagaactggagctgaccgcatcagcggaaattttactctgggatgactattttgcacctggctacggcgtgccgaacgacgaaggcatggaagcagtgaaattgctggcgcggctggaaggcattctgcttgatcctgtgtataccggaaaagcgatggcggggctgattgacggtatcagtcagaaacgcttcaaagatgaagggccgattttgtttattcataccggcggtgcgcctgcgctgttcgcctatcatccccacgtttag

SEQ ID NO: 35 - protein, 328 aa, Escherichia coli
  Escherichia coli CFT073
MPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEVLATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTGGAPALFAYHPHV

SEQ ID NO: 36 - DNA, 999 bp, Pseudomonas syringae
  Pseudomonas syringae pv. tomato str. DC3000
  CDS (1)..(999): transl_table=11
atgatcaaaaatcagcttgcccgcttcaatcgtctggacttgatcagcgcgccaacggccctggaaaagcttgagcgcctgtcgctgtgggcagatcgcgacatctacatcaagcgtgatgacaccaccacgctcgcgctgggcggcaacaaggtgcgcaagcttgaatacctggccgccgatgcgctggctcagggtgccgacacactgatcacggccggcgcaatccagtccaaccatgtacgccagacggcagccctggcggcgcggctggggctgggctgcgtggccctgctggaaaaccccatcggcaccgaagacccgagttacctgaaaaacggcaaccgcctgctgctggaactgttcgatgccaaggtcgagctggtcgaaaacctcgataacgccgacgaccagttgcatgccttggctgcgcgcctgcgctccagcggcaagaagccgtatctggtgcctatcggtggctcaagcccggttggtgcactggggtatgtccgcgccgggctggaactcgccgagcagatcaaacagaccggtatcgactttgcggccgtggtgctggcatcgggcagtgcgggtacgcacagcggcctggcgttggcgctggctcatgagttgccgcagttgccggtggtcggcgtgaccgtgtcgcgcagtgaagaagcgcagttgcccaaagtgcaaggcctcgccgagcgcaccgcgcaactgctcgatatcgccctgccggagcacttcaaggtcgaactgtgggacgagtatttcgccccgcgctacggcgagccaaacgccggtacgctggcagcgatcaaactggtggccagccaggaaggcctgttgctggacccggtctacaccggcaaggccatgtccggcctgctggacggtatcggccgtcaacgcttcaacgacgggccgttgatattcctgcacaccggtggcgcgcctgcgttgttcgcttatccggatgcgtttgaccagtga

SEQ ID NO: 37 - protein, 332 aa, Pseudomonas syringae
  Pseudomonas syringae pv. tomato str. DC3000
MIKNQLARFNRLDLISAPTALEKLERLSLWADRDIYIKRDDTTTLALGGNKVRKLEYLAADALAQGADTLITAGAIQSNHVRQTAALAARLGLGCVALLENPIGTEDPSYLKNGNRLLLELFDAKVELVENLDNADDQLHALAARLRSSGKKPYLVPIGGSSPVGALGYVRAGLELAEQIKQTGIDFAAVVLASGSAGTHSGLALALAHELPQLPVVGVTVSRSEEAQLPKVQGLAERTAQLLDIALPEHFKVELWDEYFAPRYGEPNAGTLAAIKLVASQEGLLLDPVYTGKAMSGLLDGIGRQRFNDGPLIFLHTGGAPALFAYPDAFDQ

SEQ ID NO: 38 - DNA, 981 bp, Streptomyces avermitilis
  Streptomyces avermitilis MA-4680
  CDS (1)..(981): transl_table=11
atgagtgacaagatcgccctgtcgacgtggcccacaccgctggagcccatgccccgtctggcggcggcactgggcctcggcgagaacgacctctggatcaaacgggacgacctcatcggcctgggcggcggtggcaacaaggtccgcaaactggaatggaccgtcggcgccgccctcgcggcaggcgcggacaccctggtcaccaccggcgccgcgcagagcaaccacgcccgcctcaccgcggccgccggcgcccgcctgggactcgacgtcgtactcgtcttccccggcactcccgacagcgccacgcacggctccggcaacctcgttctcgacagcctcttcggagccagggtccactgggccggagacggcggcccgagcacgatgggtgacgtcgccgacgaggtctgccggcagctgcgccgcgatggagcacgccctcatctcatccccttcggggggtcaagtcccctcggggcgcggggatacgtggaaggcggcgaggaactgcgctcccaactgcccgacgtggaccacgtcgtggtcgccctcggttccggcggcaccatggcgggactggtcggcgcactcggggagcaacgcgtcctcggcgttcactgcggggcggtggcagagccggccgccaccgtcgccgacctcgcgggcccactcacccgccgcagcatcaccccggaatccctgcgccttcgcaccgaccaggtgggtgcgggatacggagtgcttcatgagccggtcctggaagcgatgcgaaccgccgcaggcaccgagggcatcgtcctggatccggtctacagcgggcgcgccatggccggcctgatcgccgcggtgcgggacggcgacatccgcccggcccagcgcaccgtatttcttcacaccggggggctcccgggcctgttcgggcatacggagaccgtgcagcgctccgtcagcaccctgcgctcctacgaggtcgagtga

SEQ ID NO: 39 - protein, 326 aa, Streptomyces avermitilis
  Streptomyces avermitilis MA-4680
MSDKIALSTWPTPLEPMPRLAAALGLGENDLWIKRDDLIGLGGGGNKVRKLEWTVGAALAAGADTLVTTGAAQSNHARLTAAAGARLGLDVVLVFPGTPDSATHGSGNLVLDSLFGARVHWAGDGGPSTMGDVADEVCRQLRRDGARPHLIPFGGSSPLGARGYVEGGEELRSQLPDVDHVVVALGSGGTMAGLVGALGEQRVLGVHCGAVAEPAATVADLAGPLTRRSITPESLRLRTDQVGAGYGVLHEPVLEAMRTAAGTEGIVLDPVYSGRAMAGLIAAVRDGDIRPAQRTVFLHTGGLPGLFGHTETVQRSVSTLRSYEVE

SEQ ID NO: 40 - DNA, 936 bp, Streptomyces avermitilis
  Streptomyces avermitilis MA-4680
  CDS (1)..(936): transl_table=11
gtgtccgacaatggtggggtgaccggccccgacgtccccgaagcgctcgacctcgccgccctgcgaccgcgcctgccgtcgccggtgcaggcggtcgacgacgagcgcttcgcacggcacggggtccggctcctgctcaagcgggacgacctgatccacccggacctcatcggcaacaagtggcgcaagctcgcgccgaacctccgggccgcggcgggccgcccgctcgtcaccttcggcggtgcgtactcgaaccacctgcgagcgacggccgccgcgggccgcctcctggggctggccacgatcggcgtggtccgcggccaggagctggccgaccgtccgctgaacccctccctcacccggtgcgcggccgacggcatgcggctgcacttcgtggaccggtcgacgtaccgccgcaagaccgaaccggggacgctggccgcgatcctgcgcgcggtggccgccgaggacgcgtacgtcgtgcccgaaggcggcagcaactcccctgccgtacgcggctgccgcgccctcggcgaggagctgcgcgggcacgccgacgtcgtcgccctcgcctgcggcaccggcggcacgctcgcgggcctggccgccggcctcggccccggccagcgggcgctgggcgtcccggtcctcaagggcgacttcctgaccgccgaggtcaccgcgctccaggagcgggcgttcggcggccgccagggcgcctggtccctggacgaccgcttccacttcggcggctacgcccgtacctctcccggcctccacgcgttcgcggcggacttcgagcggcgacacggactgccggtggaacgtctctatgtcgccaagatgctgtacggacttgtcgccctggccgaagagggcgggttcgcccgcggcacgaccgtcgcggccgtcatcaccggacggccgctcggctga

SEQ ID NO: 41 - protein, 311 aa, Streptomyces avermitilis
  Streptomyces avermitilis MA-4680
MSDNGGVTGPDVPEALDLAALRPRLPSPVQAVDDERFARHGVRLLLKRDDLIHPDLIGNKWRKLAPNLRAAAGRPLVTFGGAYSNHLRATAAAGRLLGLATIGVVRGQELADRPLNPSLTRCAADGMRLHFVDRSTYRRKTEPGTLAAILRAVAAEDAYVVPEGGSNSPAVRGCRALGEELRGHADVVALACGTGGTLAGLAAGLGPGQRALGVPVLKGDFLTAEVTALQERAFGGRQGAWSLDDRFHFGGYARTSPGLHAFAADFERRHGLPVERLYVAKMLYGLVALAEEGGFARGTTVAAVITGRPLG

SEQ ID NO: 42 - DNA, 996 bp, Bacillus cereus ATCC
  Bacillus cereus ATCC 14579
  CDS (1)..(996): transl_table=11
atgaatttagctaaattcccgagaaaaaaatatacagaatcatatacaccaattgaaaagttaaacaatttttctgaagcacttggtggtccgactatttattttaaacgagatgatttacttggtttaacagccggtggcaataagacgagaaagttagaatttttagttgcagatgcacaggaaaatggtgcagatacgttaattacagctggtggtattcagtcaaatcattgccgcctgacacttgctgctgcggtaaaagaaaaaatgaaatgtatccttgtattagaggaagggcttgagacagaagagaagagagactttaacggaaactatttcttatatcacttattaggtgctgaaaacgtcattgttgtaccgaacggagcagacctgatggaagaaatgcataaagtagcaaaagaagtaagtgaaaaaggaaatacaccatatgtaattccagttggtggatcaaaccctacaggcgctatgggatacgttgcttgtgcgcaagaaattatggcgcaatcatttgagcaaggaattgatttcagttcagttgtttgtgtaagtggtagcggcggtatgcatgctggtttaattactggtttttctggaacacaaagccatattcctgtaatcgggattaatgtaagtagaggaaaagctgagcaagaagagaaagtagcaaaacttgtagatgaaacttcagcacatgttggtattccaaactttatctcgcgcgacgctgttacgtgctttgatgaatatgtaggaccaggctatgcgttaccaacgccggaaatggtagaggcagttcagttacttgcgaaaacagaaggtattttacttgatccagtgtatacaggtaaggcagtagcgggattaatcgacttaattagaaaaggtaattttaataaggaagacaatattttattcgtacattcaggtggttcaccagctttatatgcgaatacttctttatttgtgtaa

SEQ ID NO: 43 - protein, 331 aa, Bacillus cereus
  Bacillus cereus ATCC 14579
MNLAKFPRKKYTESYTPIEKLNNFSEALGGPTIYFKRDDLLGLTAGGNKTRKLEFLVADAQENGADTLITAGGIQSNHCRLTLAAAVKEKMKCILVLEEGLETEEKRDFNGNYFLYHLLGAENVIVVPNGADLMEEMHKVAKEVSEKGNTPYVIPVGGSNPTGAMGYVACAQEIMAQSFEQGIDFSSVVCVSGSGGMHAGLITGFSGTQSHIPVIGINVSRGKAEQEEKVAKLVDETSAHVGIPNFISRDAVTCFDEYVGPGYALPTPEMVEAVQLLAKTEGILLDPVYTGKAVAGLIDLIRKGNFNKEDNILFVHSGGSPALYANTSLFV

SEQ ID NO: 44 - DNA, 996 bp, Bacillus anthracis
  Bacillus anthracis str. Ames
  CDS (1)..(996): transl_table=11
atgaatttagctaaattcccgagaaaaaaatatacagagtcatatacaccaattgaaaaattaaacaatttttcagaagcacttggtgggccgactatttattttaaacgagatgatttacttggtttaacagctggtggtaataagacgagaaagttagagtttttagttgcggatgcacaggcaaagggtgcagatacgttaattacagctggtggtattcagtcaaatcattgccgcctaacacttgcagcggcggtaaaagaaaaaatgaaatgtatccttgtattagaagaagggcttgagccagaagagaagccagactttaatggaaactatttcttatatcatttactaggtgctgaaaatgtcattgttgtaccgaacggagcagatcttatggaagagatgcataaagccgcgaaagaagttagtgaaaaagggaatacaccatatgtcattccggtcggtggatcgaatcctactggagcaatgggatacgttgcttgtgcgcaagaaattatagcgcaatcatttgaccaaggaattgatttcagttcagtcgtttgcgtaagtggtagcggcggtatgcacgctggtttaattacaggttttgctggaacacaaagtaacatccctgtaatcggaattaacgtaagtagaggaaaagcagagcaagaagagaaagtagcaaaacttgtagatgaaacgtcagctcatgttggtattccaaactttatcccgcgcgaagcggttacatgctttgatgaatatgtaggaccgggttacgcgttaccaacgccagaaatggtggaagcagtgcagctgttagcaaaaacagaaggtattttacttgatccagtatatacaggtaaagcagtagcgggattaatcgacttaattagaaaaggtacatttaataaagaggataacattttattcgtacattcaggtggttcaccagctttatatgcgaatacatctttattcgcgtaa

SEQ ID NO: 45 - protein, 331 aa, Bacillus anthracis
  Bacillus anthracis str. Ames
MNLAKFPRKKYTESYTPIEKLNNFSEALGGPTIYFKRDDLLGLTAGGNKTRKLEFLVADAQAKGADTLITAGGIQSNHCRLTLAAAVKEKMKCILVLEEGLEPEEKPDFNGNYFLYHLLGAENVIVVPNGADLMEEMHKAAKEVSEKGNTPYVIPVGGSNPTGAMGYVACAQEIIAQSFDQGIDFSSVVCVSGSGGMHAGLITGFAGTQSNIPVIGINVSRGKAEQEEKVAKLVDETSAHVGIPNFIPREAVTCFDEYVGPGYALPTPEMVEAVQLLAKTEGILLDPVYTGKAVAGLIDLIRKGTFNKEDNILFVHSGGSPALYANTSLFA

SEQ ID NO: 46 - DNA, 1026 bp, Bordetella bronchiseptica
  Bordetella bronchiseptica RB50
  CDS (1)..(1026): transl_table=11
atgctacatcttgccaagtttccccgcataaaactcgggcacttccccaccccgctcgaattcatgcccaacctgacccgccacctgggcggaccgaacctctacatcaagcgcgacgactgcaccggcctggccaccggcggcaacaagacgcgcaaactggagtttctggtggcccaggccgttgcgcaaggggcggatacgctgatcacccagggcgccgtccagtccaaccacgcgcgccagaccgccgcggccgccgcgcgcgtcggcatgaagtgcaagatcctcctggaagagcgtgtcccgcatccggacgatgactactcccactccggcaacgtcatgctcgacggcctgatggacggcgagatcgtcgcgcgcctgcccgccggcaccgacatgcagcaggccatggaagacctggcccgcgaactggccgggcgcggcagcaagccctacgtcatcgccggcggcggctcgaccccggtcggcgcgctgggatacgtggcctgcgcgcaggagctgctgcaccaatcgttcgaaaccgggctgcgcatcgaccatgtcgtgcacgcgaccggcagcgccggcacgcaggccgggctggtggtcgggctgcgcgccggcaacagcggcattccggtctacggcatcagcgtgcgggcgcccaagcccaggcaggaagaaaacgtctggaagctggtgcagtccacggtcgattacatgggcctgcccgccagcgcggtggagcgcgccgacgtggtggccaattccgactacgtcggcgagggatatggcatctccaccgacgcgatgatcgaggcggtgcacatgaccgccgcactggaagccatcctgctggaccccgtctactcgggcaaaggcatggccggcctgatcggattgatccgttcgggtcatttcaagcagggcgagaacgtagtgttcgttcacacgggaggcgcagtaggcctgttcggttaccgccgcgcattcgaaggcctgcctccattggccgcctag

SEQ ID NO: 47 - protein, 341 aa, Bordetella bronchiseptica
  Bordetella bronchiseptica RB50
MLHLAKFPRIKLGHFPTPLEFMPNLTRHLGGPNLYIKRDDCTGLATGGNKTRKLEFLVAQAVAQGADTLITQGAVQSNHARQTAAAAARVGMKCKILLEERVPHPDDDYSHSGNVMLDGLMDGEIVARLPAGTDMQQAMEDLARELAGRGSKPYVIAGGGSTPVGALGYVACAQELLHQSFETGLRIDHVVHATGSAGTQAGLVVGLRAGNSGIPVYGISVRAPKPRQEENVWKLVQSTVDYMGLPASAVERADVVANSDYVGEGYGISTDAMIEAVHMTAALEAILLDPVYSGKGMAGLIGLIRSGHFKQGENVVFVHTGGAVGLFGYRRAFEGLPPLAA

SEQ ID NO: 48 - DNA, 1224 bp, Oryza sativa
  Oryza sativa (japonica cultivar-group)
  CDS (1)..(1224)
atgcggccatcgccggcgctcgccggcggcggcaggacggtcgcaaatcttctctccgccacggagtggatgcttccttctccggccacccaagtccacaccatctccgtcctcccctcccactcaccgccgtcccctcctcaccacttcgcgttctccaacctcaccaccgcgcctaagcgcaacggaggcaagggggaagaggagggccgcccaaggttcgaggtggtgcgcgacgatctcctccacccgctcgccaatggcaacaaggcccgcaagctcgacgccctcctgccgctcctgcgccgccgcggcgctactgacgttgtgacttgtgggggttgccagagcgcccatgctgcggccactgcggtccactgtgctgagtggggaatgaggccacacatattgctgagaggtgaacagccagatatcccgacaggctacaatcttatctctttgatgtttggcaatgtggcttatgcctctcggtcagtgtacgcacacagagatgaaatgctttacaatcacgccagaaaagttgcaggcacaggtggtacagtgttgtgggctgatgatattagcaaagaggattttgttttagatgaagataatggttgtgaaattggttcgagaagagtagttattattaaggaaggggctggtgacgtccaagcattgctaggtgttattcggctagtggagtacctttacaatctgtcgtcatttcataaacatgagaatgttcatgtcgtggtagatgctgggacaggcacaacagctgtggggttagctcttggagcggtatgtctaggattgcattggagagtaactgctgtcatgcttgctgacacactcgaaagatataaagaacgagagaagtccttaatatctgactttaagaagctttgccataacaactaccatgaaatggtgggagaaaatgatattggtgacagtttagttgaatgggtggaacgattttcaccaagacgatttggcaaggtgctgaacggtgaaattgcattatgccgccagattgcgcagcaaactggtatcctgttggatccaatgtacaccttagctggttgggagcaagctgtggatctatgtgttggagacagtagaaccaaagtggtgatgatccatacgggaggaacgcttggcttctgcggattggcgcagcggtactcatcgcacttcacctcggatgagcaaacttag

SEQ ID NO: 49 - protein, 407 aa, Oryza sativa
  Oryza sativa (japonica cultivar-group)
MRPSPALAGGGRTVANLLSATEWMLPSPATQVHTISVLPSHSPPSPPHHFAFSNLTTAPKRNGGKGEEEGRPRFEVVRDDLLHPLANGNKARKLDALLPLLRRRGATDVVTCGGCQSAHAAATAVHCAEWGMRPHILLRGEQPDIPTGYNLISLMFGNVAYASRSVYAHRDEMLYNHARKVAGTGGTVLWADDISKEDFVLDEDNGCEIGSRRVVIIKEGAGDVQALLGVIRLVEYLYNLSSFHKHENVHVVVDAGTGTTAVGLALGAVCLGLHWRVTAVMLADTLERYKEREKSLISDFKKLCHNNYHEMVGENDIGDSLVEWVERFSPRRFGKVLNGEIALCRQIAQQTGILLDPMYTLAGWEQAVDLCVGDSRTKVVMIHTGGTLGFCGLAQRYSSHFTSDEQT

SEQ ID NO: 50 - DNA, 996 bp, Bacillus cereus
  Bacillus cereus ATCC 10987
  CDS (1)..(996): transl_table=11
atgaatttagctaaattccctagaaaaaaatataccgaatcatatacaccaattgaaaaattaaacaatttttctgaagcacttggtgggccgactatttattttaaacgagatgatttacttggtttaacagctggtggtaataagacgagaaagttagagtttctagttgcggatgcgcaggtaaagggtgcagatacgttaattacagctggcggcattcaatcaaatcattgccgcctaacacttgcagctgcggtaaaagaaaaaatgaaatgtattcttgtattagaagaagggcttgagccagaagagaagccagattttaacggaaactatttcttatatcatttactaggtgctgaaaatgtcattgttgtacgaaacggagcagatcttatggaagagatgcataaagtcgcgaaagaagttagtgaaaaaggtagtacaccatatgtaattccggttggtggatcaaatcctactggcgcaatggggtacgttgcttgtgcgcaagaaattatggcgcaatcatttgaccaaggaattgatttcagttcagtcgtttgcgtaagtggtagcggcggtatgcacgctggtttaattactggttttgctggaacacaaagtaacattccagtaatcggcattaacgtaagtagaggaaaagcagagcaagaagagaaagtagcaaaacttgtagatgaaacgtcagctcacgttggtattccaaactttatcccgcgcgaagctgttacatgctttgatgaatatgtaggaccaggttatgcgttaccaacgccggaaatggtggaagcagtgcaattacttgcgaaaacagaaggtattttactggatccagtgtatacaggtaaagcagtagcggggctaatcgacttaattagaaaaggtacatttaaaaaagaagacaacattttattcgtacattcaggtggttcaccagctttatatgcgaatacgtctttatttgtgtaa

SEQ ID NO: 51 - protein, 331 aa, Bacillus cereus
  Bacillus cereus ATCC 10987
MNLAKFPRKKYTESYTPIEKLNNFSEALGGPTIYFKRDDLLGLTAGGNKTRKLEFLVADAQVKGADTLITAGGIQSNHCRLTLAAAVKEKMKCILVLEEGLEPEEKPDFNGNYFLYHLLGAENVIVVRNGADLMEEMHKVAKEVSEKGSTPYVIPVGGSNPTGAMGYVACAQEIMAQSFDQGIDFSSVVCVSGSGGMHAGLITGFAGTQSNIPVIGINVSRGKAEQEEKVAKLVDETSAHVGIPNFIPREAVTCFDEYVGPGYALPTPEMVEAVQLLAKTEGILLDPVYTGKAVAGLIDLIRKGTFKKEDNILFVHSGGSPALYANTSLFV

SEQ ID NO: 52 - DNA, 1206 bp, Magnaporthe grisea
  Magnaporthe grisea 70-15
  CDS (1)..(1206)
atgagcaccaacgatatcaagctccctgagccatttgcgagcattcctcgggaaacttttctatttggcccctcgcccatacagcacctggaacgcatctcagaagcactaggcggcaaggtgaacgtttacgcaaagcgtgatgactgcaattcgggtttggcatatggcggcaacaagacgcggaagctagaatacctcgcggcagaagccaaggcgcagggcgctgacacactcgtgtccattggcggcgtgcaatcaaaccacacgcgccaggtcgcggccgtctcgaccaagctcgggctcaaggctgtcctggtgcaggagcactgggtgcccgactggtcggatccggtgtacggcaaggtgggcaacatccagctgtcgcggctgatgggcgccgacgtcaagctggacccgtccgggttcggcatcgagcacaagaactcgctcgcggcggcggtggcggagctgcagtcgcaggggagaaggccgtacgcgatcccggcgggggccagcgaccacccgctcggcgggctgggcttcgcgcgctgggcgttcgaggtcgaggagcaggagcggcagatgggcgtcttcttcgacacggtgattgtgtgcgccgtcacgggctcgaccatggcgggcatggtggccgggttcaagctggcgcagaaaaagtgcgggtccaagccgcggcgcgtcatcggcatcgacgcctcggccacggtgccgcagaccaaggagcaggtgctgcgcatcgcgcaggtgacgggccgcaagattggcctcgaggacggcgtcgacaacgtcacgaccgaggacgtcgagctggacgaccgctaccacgccggcatctacggcgtcccggaccagcagaccaaggacgccatccgcttcggggccagcaccgaggccttcatcaccgatcccgtctatgagggtaagagcttggccggcatgatggacatgattcgcaaaggggagatcaagcccgggagcaacgtcttgtatgcgcacttgggcggccagcttgcgctcaatgcgtactctgacatattcattgtgcatcgtcgtcaatcttctctgggtaatcccatggccaacccatggccaaaacacgctatgcacttggctgaatactctccggccaatacttggtggtggtcaaaagccacaatgtgcggatgcaagaaacataccctctga

SEQ ID NO: 53 - protein, 401 aa, Magnaporthe grisea
  Magnaporthe grisea 70-15
MSTNDIKLPEPFASIPRETFLFGPSPIQHLERISEALGGKVNVYAKRDDCNSGLAYGGNKTRKLEYLAAEAKAQGADTLVSIGGVQSNHTRQVAAVSTKLGLKAVLVQEHWVPDWSDPVYGKVGNIQLSRLMGADVKLDPSGFGIEHKNSLAAAVAELQSQGRRPYAIPAGASDHPLGGLGFARWAFEVEEQERQMGVFFDTVIVCAVTGSTMAGMVAGFKLAQKKCGSKPRRVIGIDASATVPQTKEQVLRIAQVTGRKIGLEDGVDNVTTEDVELDDRYHAGIYGVPDQQTKDAIRFGASTEAFITDPVYEGKSLAGMMDMIRKGEIKPGSNVLYAHLGGQLALNAYSDIFIVHRRQSSLGNPMANPWPKHAMHLAEYSPANTWWWSKATMCGCKKHTL

SEQ ID NO: 54 - DNA, 984 bp, Gibberella zeae
  Gibberella zeae PH-1
  CDS (1)..(984)
atggtcactcttccgtcaccttttagcgacatcgatcgtgtccagctgttgttcaatcgccccacagacattgaaccgctctcccgtctcacagaatctgtcaataataacgtcaagctatggatagctcgtgaagatcgcaattcaggtctcgcattcgctggaaacaaggttcgcaagcttgaatatgtgctagcagatgctcttgcccaaggagcagacaccgttgtgactacaggtggcatccagtcaaaccacatgtgtcaaacctctgctgctgctgctcgacttggcctcaaagtcgctctttatcctgcggaccgtgttgcttcgaatgacgccgagtacaaatatttgggcaatatacaggcaaacgccattctcggtgccgagacgtttccggtcgacacagctgaagagactgttatcacgactcttaaagatcgtggccaaaaaccctactccattcctcccggagctagctcccatccccttggaggccttggctatgctcgctgggcgtttgaattgctagagcaagaaaagaagatcggcgtgacctttgataccatagcactcgttgcagggtcttgctctaccctaggaggtttactcgccggattgaagcttgcacaaaaagagcaaattccaggttccaagaaacgccttattggattttcggttctgcacaagtctaagaaggatgtcgaagcactggttctcaaaacatcccgaaccacagcatcaaagattggaatttcacccaacgagataaccgcagacgatttcgagattaatacttcctatataggtgatgggtacgggcaactcaatgactccacagctgaggcgatgaagaagctagcaaggaaggaaggtatcctgaccgaccctgtttacaccggcaaggcgtttactggcttgcttgatcttgccaagacaggatatttgaacgtatctacgaccattgttctaaacatctaa

SEQ ID NO: 55 - protein, 327 aa, Gibberella zeae
  Gibberella zeae PH-1
MVTLPSPFSDIDRVQLLFNRPTDIEPLSRLTESVNNNVKLWIAREDRNSGLAFAGNKVRKLEYVLADALAQGADTVVTTGGIQSNHMCQTSAAAARLGLKVALYPADRVASNDAEYKYLGNIQANAILGAETFPVDTAEETVITTLKDRGQKPYSIPPGASSHPLGGLGYARWAFELLEQEKKIGVTFDTIALVAGSCSTLGGLLAGLKLAQKEQIPGSKKRLIGFSVLHKSKKDVEALVLKTSRTTASKIGISPNEITADDFEINTSYIGDGYGQLNDSTAEAMKKLARKEGILTDPVYTGKAFTGLLDLAKTGYLNVSTTIVLNI

SEQ ID NO: 56 - DNA, 1158 bp, Oryza sativa
  Oryza sativa (japonica cultivar-group)
  CDS (1)..(1158)
atggccggagtttccgccgcctccgccgccgggaagatcgggagcttcctctccaagaggccgtacgcgccgccgtcctgggcctcgcacctgtcccccgccccctcgcagaccttctcgctcggccatttcccgacgccgatccacaagtggaatctgcccaatttgccgaatggcacggaggtgtggatcaagcgagacgacatctcaggcatgcagttgagcgggaacaaggtccggaagctcgagttcctgatggcagatgccgtcgcgcagggcgctgactgcgttataactgtaggtggcatccagagcaatcactgccgtgccaccgcagtggctgcaaagtatataaatcttgattgttatctgatactgcgcacatccaagcttcttgtggataaggaccctggtttggttgggaatctccttgttgagagattggtgggagcgcatattgatcttgtttcaaaagaagaatatggaaaaattggcagtgtggctttagcggacttgctgaaaaagaagcttttggaagaaggccgaaaaccatatgttattcctgttggtggatcaaactctctaggaacttggggatatatagaagcaataagggagattgaacatcaaattcagatatcaggtgatgttcagtttgacgacattgttgttgcatgtggcagcggtggaaccattgctggtcttgctttaggatcaaaattgagtagcttaaaggcaaaagtccatgctttctctgtttgtgatgatcctggatatttccattcctatgttcaagacctgattgatggacttcattctgatttgcgttcacatgatttagtcaacattgaaaatgctaagggcttaggttatgccatgaacacagctgaggagcttaagtttgttaaagatatagctacagcaacaggcattgtccttgatccagtctacagtggaaaggcagcatatggaatgctgaaagacatgggtgctaatccagctaagtgggaagggcgaaaaattctttttgtacatacaggtggtcttcttggtttgtatgataaggttgatgagttatcatctttgagtgggagttggcgcagaatggatcttgaagaatctgttccacgcaaagatggaactggtaagatgttctga

SEQ ID NO: 57 - protein, 385 aa, Oryza sativa
  Oryza sativa (japonica cultivar-group)
MAGVSAASAAGKIGSFLSKRPYAPPSWASHLSPAPSQTFSLGHFPTPIHKWNLPNLPNGTEVWIKRDDISGMQLSGNKVRKLEFLMADAVAQGADCVITVGGIQSNHCRATAVAAKYINLDCYLILRTSKLLVDKDPGLVGNLLVERLVGAHIDLVSKEEYGKIGSVALADLLKKKLLEEGRKPYVIPVGGSNSLGTWGYIEAIREIEHQIQISGDVQFDDIVVACGSGGTIAGLALGSKLSSLKAKVHAFSVCDDPGYFHSYVQDLIDGLHSDLRSHDLVNIENAKGLGYAMNTAEELKFVKDIATATGIVLDPVYSGKAAYGMLKDMGANPAKWEGRKILFVHTGGLLGLYDKVDELSSLSGSWRRMDLEESVPRKDGTGKMF

SEQ ID NO: 58 - DNA, 1011 bp, Aspergillus nidulans
  Aspergillus nidulans FGSC A4
  CDS (1)..(1011)
atgccctcacaagacgtccccctaccagagccatttgcttctgttcctcgagaaaccctgaccttcggcccctcacccatccaatacctccctaacatcactgccgcgctaggcggaaaagtcaacatctacgctaaacgcgaagatgtcaacagcggcctcgctttcgggggcaacaagacccggaaacttgagtacctcgcgtccgacgccctcgctcaaaaggcagatacgttggtgtcgatcggcggcttccaaagcaaccacacgcggcaagtcgcggccgtcgcgcggaagcttggcctcgaagttgcgcttgtacaggaaaaatgggttgattgggacgacaaaaatggcgtttacgacaaggcggggaatatccagctttcgcggctgatgggcgcagacacgagactcgatatgtccggcttcgggattgaacataaattgaccctcaagaacttggaggaggaaatcagagccaggggcggaaagccatattacatccctgcaggagcatcagatcacccattgggcggcttaggcttcgccaggtgggcgtttgaggttgagatgcaggagaaggagctcggtgtattctttgacactgtgattgtgtgcgcagtaacagggagtacaatggcgggcatgattgcgggcttcaagctcgcgcagaaagtaaacgggagccgcaagcggaagatcattgggattgatgcgtcagcgacggtggagcagacatttgagcaaatattgcgcattgcaaagttcacaggtgtcaagataggtttggacgaggaggatatcacggcggaggatgtgatattagatgatcggtatcacgctggtgtgtatgggattccagatgaggcgaccattgaggcgatcaagtttggggccaggactgaggctttcattacggatcctgtgtatgaagggaagagcctgaatgggatgatggatatgggtttattgtcttgctgccggattgtattcagagtaaagtcgtag

SEQ ID NO: 59 - protein, 336 aa, Aspergillus nidulans
  Aspergillus nidulans FGSC A4
MPSQDVPLPEPFASVPRETLTFGPSPIQYLPNITAALGGKVNIYAKREDVNSGLAFGGNKTRKLEYLASDALAQKADTLVSIGGFQSNHTRQVAAVARKLGLEVALVQEKWVDWDDKNGVYDKAGNIQLSRLMGADTRLDMSGFGIEHKLTLKNLEEEIRARGGKPYYIPAGASDHPLGGLGFARWAFEVEMQEKELGVFFDTVIVCAVTGSTMAGMIAGFKLAQKVNGSRKRKIIGIDASATVEQTFEQILRIAKFTGVKIGLDEEDITAEDVILDDRYHAGVYGIPDEATIEAIKFGARTEAFITDPVYEGKSLNGMMDMGLLSCCRIVFRVKS

SEQ ID NO: 60 - DNA, 1200 bp, Aspergillus fumigatus
  Aspergillus fumigatus Af293
  CDS (1)..(1200)
atggcagtccctctaccggcagcttttgctcagattcctcggtatcctcttctataccctcatccttccccgatccaccccctcacacttctatccacatacctcaacaacagccgcaacaataatacggccaaaacaccgtatatctccctctacgccaaacgagaagaccactcttccccactcgcctgcgcagggaacaaataccgcaagcttgaatacattatccccgacatccgggcctctcacagcgcccccaatgaacccccaccaaccctcgtcactgagggcgccatccagagcaaccacaccgtgcaggtcgccgcggtagcgaaacgactcggcctcgaggcagtcgtcatccttcacaaaggcacaggcggcggtctagccgcctcaaccgataaagtctcgttcctgcgcacgggaaacccgcaagtcgtccgtctcctgggggcggaggtgaggatgctggagtcgtcgactgttcccgcagacggggataaggatccgattcctgggattctggaggagttacgcgcgcagggcaaggcgccgtattggatcccttccggggcaagtctgcatcctctcggtggattggggtatgcgcgctgtgcgtttgagattgcgatacaggagcaggcgcaaggtttggatgggagtgggcgctttgattatatcttcgttgcgtgcgggagtggcagtacggtgggcggtttgatcgccgggctgaagctgttggagaagaaggaaggcagaacctggttgagcaaaccacctcggcaagtcattgggatcttgacttcgcctaccaagcctcaggagtaccatgaagagcgggtactcacctttgcgcgtcgcgcagctgctcttattgggttggatgccgaaaaggacatttctatggatgatgttcggcttgatgatcggttcgctggcaccgcatatggcgttctagacgcccagacaagcacggcgctggacttaatggcgaaaaaggaggcagtaatgctagatcccgtatatacttcaaaggtcgtacggggactcttgcactgggtacagcaagaggagctggcaaaggactggtcacttcgtctgggagatcgagaacgtcccgactgcatgaatgtgcttttcatccacactggaggacaggctgcgttaggcgcctacgcagacatggtcgaattatag

SEQ ID NO: 61 - protein, 399 aa, Aspergillus fumigatus
  Aspergillus fumigatus Af293
MAVPLPAAFAQIPRYPLLYPHPSPIHPLTLLSTYLNNSRNNNTAKTPYISLYAKREDHSSPLACAGNKYRKLEYIIPDIRASHSAPNEPPPTLVTEGAIQSNHTVQVAAVAKRLGLEAVVILHKGTGGGLAASTDKVSFLRTGNPQVVRLLGAEVRMLESSTVPADGDKDPIPGILEELRAQGKAPYWIPSGASLHPLGGLGYARCAFEIAIQEQAQGLDGSGRFDYIFVACGSGSTVGGLIAGLKLLEKKEGRTWLSKPPRQVIGILTSPTKPQEYHEERVLTFARRAAALIGLDAEKDISMDDVRLDDRFAGTAYGVLDAQTSTALDLMAKKEAVMLDPVYTSKVVRGLLHWVQQEELAKDWSLRLGDRERPDCMNVLFIHTGGQAALGAYADMVEL

SEQ ID NO: 62 - DNA, 1053 bp, Aspergillus fumigatus
  Aspergillus fumigatus Af293
  CDS (1)..(1053)
atgaccctagaaatccccctcccagaacccttcgcctccatcccccgctacaccctcaccctcggcccctcccccatccacctcctccccaacacctccgccgatttgcacaccaccatctacgccaagcgcgaggacctcaactccgccctcgcctacggcggcaacaaaacccgcaaactcgagtatcttctcgcggacgccctcgcccaaaacgccacgaccctgctctccatcggcggcgtccaatccaaccacacccgtcaggtcgccgccgccgccgcacacgccggcctcaccgcccgtctcgtgcaggagcactgggtcgactggaacgacgcccattacgaccaggtaggcaatatccagctgtcgcggctgatgggcgcggatgtgcggctgcatccagcggggttcggcatcgagcataaagagagtctgcgccagttgctgggcgagtgcgaggcgcgcggcgagcgcgcgtactacatcccggcgggtgcgtctgaccatccgctcggcgggctggggtttgcgcggtgggcgtttgaggtggcgatgcaggagcgcgagatgggggtgttcttcgatgtggtggtggtgtgtgcggtgacggggagtacgtttgcgggcatgattgctgggtttaagttgctggagcgggtgcagcctggtagtagaaaaaggcgggttatcgggattgatgcgtccgcgcggccggcggagacgagggcgcaagtgatgcggattgcgaggagtacagctgcgaagattggtttgaaggacgaggatatctccgaggaggatgtggttctgaatgagaattaccatgagggggtttacggggtacctggcgaggggaccatcaaggctatggagtatgccgccagcaaagatgcgttcattacggaccctgtgtacgaagggaagagcttcgcggggttgatcgatttggcgaagaagggcgagtttgcggggaagacggtgctttacgcccatcttgggggtcagccggctttgaatgcgtatagcgagattggtcgggcgaagtag

SEQ ID NO: 63 - protein, 350 aa, Aspergillus fumigatus
  Aspergillus fumigatus Af293
MTLEIPLPEPFASIPRYTLTLGPSPIHLLPNTSADLHTTIYAKREDLNSALAYGGNKTRKLEYLLADALAQNATTLLSIGGVQSNHTRQVAAAAAHAGLTARLVQEHWVDWNDAHYDQVGNIQLSRLMGADVRLHPAGFGIEHKESLRQLLGECEARGERAYYIPAGASDHPLGGLGFARWAFEVAMQEREMGVFFDVVVVCAVTGSTFAGMIAGFKLLERVQPGSRKRRVIGIDASARPAETRAQVMRIARSTAAKIGLKDEDISEEDVVLNENYHEGVYGVPGEGTIKAMEYAASKDAFITDPVYEGKSFAGLIDLAKKGEFAGKTVLYAHLGGQPALNAYSEIGRAK

SEQ ID NO: 64 - DNA, 1248 bp, Strongylocentrotus purpuratus
  CDS (1)..(1248)
atggcaaacgatggtctgtttctttccaatgaaaatgaagtggctctaacaatccaagtcttcagaaaccatgctattacatttttggctaacctgaacacccctatccacaaatggcgtcttccacggacacctgatgactttgaggtctttgtcaagagggatgacatgacaggaagtgttctctcaggcaacaagttggctaacctgaacacccctatccacaaatggcgtcttccaaggacacctgatgactttgaggtctttgtcaagagggatgacatgacaggaagtgttctctcaggcaacaagatccgtaagcttgagttcctattggctgatgcagtagataaagggtgtgaggtcatcttgacgtgtggaggagtccgatccaatcactgccgagcgacggccatctcgtcttgtcagcttgggttagaatgccatctatttctgtggtccagaactaaggaccttaagggccagttcacggggaacactcttttagacaggatggttggagccaacttttatcttgtaccatcagagtgctcgttccagaaggagatctatcccagaatgcaacagctccaagagcatataatgaagacatcagggaagaagtgttattccatacctctgggtggctccaactgtgttggtgtgtgggggtatatagactgcttcaatgaactcatgaaacagggtttacatgagagattcacagacattgtcgtagcatcgggaagcacaggatctgtaactggtcttgccatagggaaccatctgacaggaaacaaagtcaaagtccatggcatggcagtcatatccgacgctgcttactttcacgaggaagcggacgcaatcttgagagacctaggcttgcaggccagtgatgggtcatcaggggtcaaggctgcggacattatggacatcgtggagggagtgaagggcataggttatggtctgtccacaccagaggaattagaatgtatccaagaggttgccacgacaacaggtatcctggtagatccgtgctacacagggaaggccacgtaccataccatgaaactcatgagagaaaaccctgacaggtttataggaaagaagatactctttattcatacaggaggatggtttgatctgttcagtggagtgatgtcatccgccatcgatggcaagagctctgcagaaaacaaggtctatgattggatggaaatgactgacaaattgccattcaaccaatag

SEQ ID NO: 65 - protein, 415 aa, Strongylocentrotus purpuratus
MANDGLFLSNENEVALTIQVFRNHAITFLANLNTPIHKWRLPRTPDDFEVFVKRDDMTGSVLSGNKLANLNTPIHKWRLPRTPDDFEVFVKRDDMTGSVLSGNKIRKLEFLLADAVDKGCEVILTCGGVRSNHCRATAISSCQLGLECHLFLWSRTKDLKGQFTGNTLLDRMVGANFYLVPSECSFQKEIYPRMQQLQEHIMKTSGKKCYSIPLGGSNCVGVWGYIDCFNELMKQGLHERFTDIVVASGSTGSVTGLAIGNHLTGNKVKVHGMAVISDAAYFHEEADAILRDLGLQASDGSSGVKAADIMDIVEGVKGIGYGLSTPEELECIQEVATTTGILVDPCYTGKATYHTMKLMRENPDRFIGKKILFIHTGGWFDLFSGVMSSAIDGKSSAENKVYDWMEMTDKLPFNQ

SEQ ID NO: 66 - DNA, 1137 bp, Strongylocentrotus purpuratus
  CDS (1)..(1137)
atggccgatttccctcttaagtcttactctgcagcgccatggatggaggaattgaagcatattccaaggcatagactcgagcttgccatgctgaacacccccatacacagatggaatcttcctggaacaccagcaaactttgacgttttcattaagagagatgacatgacagggagctcattgtcaggaaataagattcgtaagcttgaattcttgttagcagacgcagtaagccagggttgtgatacagtgataacttgtggaggagtaagatccaaccactgtagaaccacagccgtagcaaccagacaacttggtatggactgccatcttcttctcagatcagaggcaacaaacctagatggatcattcacaggcaacacattgttagacagtatggttggatgtagtttctatctcatacccaagaaatctcagtacaactcacacatctatcccagaatgcaacagcttgtagagtatctaagagattctctaggaaagaaagcctacccaatcccaataggtggatctaactcagtaggagtctttggatacctggaatgcttcagagaactcctccagcagaatgttcaggagaggttcagcgatattgtcataacatcaggcagtagtggatcactagctggtcttgcaattggcaactatctgacaggaagcaaactcaggattcatggaatggcaatatgtgatgacgcaaaatattttcatggagaaatcaacaaggttttacgtgaacttggcatgcaggaaggtcaagggtcatcaggggtcaggtcagaggacattgtagatgtcgtggaaggggtcagagggctcgggtatggtttatctcagcctgaagaacttgaatgcattaaccaagtagccaggaccactggtatctttgttgacccagtctatactggtaaggcaacctttcacctcatgcgtctgatgaaggaggaaccagacagattccaaggatccaagattctcttcattcatacaggaggagtgtttgatctgttcagtggtgccatgggttctatggctgataaaaggacttcatcagagaagaaggtttatgattggatggaaatgactgaaaaaacacccctctgccaatcaggatga

SEQ ID NO: 67 - protein, 378 aa, Strongylocentrotus purpuratus
MADFPLKSYSAAPWMEELKHIPRHRLELAMLNTPIHRWNLPGTPANFDVFIKRDDMTGSSLSGNKIRKLEFLLADAVSQGCDTVITCGGVRSNHCRTTAVATRQLGMDCHLLLRSEATNLDGSFTGNTLLDSMVGCSFYLIPKKSQYNSHIYPRMQQLVEYLRDSLGKKAYPIPIGGSNSVGVFGYLECFRELLQQNVQERFSDIVITSGSSGSLAGLAIGNYLTGSKLRIHGMAICDDAKYFHGEINKVLRELGMQEGQGSSGVRSEDIVDVVEGVRGLGYGLSQPEELECINQVARTTGIFVDPVYTGKATFHLMRLMKEEPDRFQGSKILFIHTGGVFDLFSGAMGSMADKRTSSEKKVYDWMEMTEKTPLCQSG

SEQ ID NO: 68 - DNA, 1155 bp, Strongylocentrotus purpuratus
  CDS (1)..(1155)
atgggtcacgtgttggagccaaataacgattaccccctcttgccatacgatgctcccgagtggacatcccgactcgccgtcatccccaagtatcgagttcagttggggtctctaggcacccctatccagcgctggcgtctcccaggcatgcctgaggacttccaagtccacatcaaacgagacgatatgacaggcagcgtactctctggaaacaaggtgaggaagctagagtttttgatggctgactgcttggatcagggttgtgaatccatcataacctgtggtggtgtgttctcaaactcctgccgggccggagccattgctgcccgccaaatgggactggacagccatctcttcctctggtcagaatccacggatctgccgttcacggggaatgctttgctggaccgcctggtgggctgtaacttctacctcatgccgttagactgccctctggagacgcaagtataccctcgcatgaagctacttcaagaccacatccagaaaacgaccaataagaaggcttacagactgccttttggaggatccaatgaggttggagtatggggctacatcgagtgcttccgtgaactaatgggccagggactcctggacagattcaccgacattgtaatcgcagccggtagcagcgggtctgtgaccggccttgccattgcaaactacctcaccggtagcaaactaaagatacacggctttgcagcatgcaaggaccaaatgtttttctacgacctcggcgacaagacactccaatccctcgggctacaggacgctgatggcgcaggggtcaaagcggtcgacatcatgcacattcgtgacgaagtggttggcatcgggtatgccgtcaacacttcagaagaattagaatgcatcgagcaggtggcgatgaacaccgggattcttgtggaccctgtctactccggcaaggccacctatcatctactcaaactcatgaacgagaaaccaggaacgttcaagggaaagcagatcctcttcatacatacaggtggtgtctttgacctgttcagcggtgccgttggttctcggctcacaaagaaaggccataaagaaaacaaagtctacgactggatggacctctccgacaaagtcccagacaaggtctcagctgcatcctag

SEQ ID NO: 69 - protein, 384 aa, Strongylocentrotus purpuratus
MGHVLEPNNDYPLLPYDAPEWTSRLAVIPKYRVQLGSLGTPIQRWRLPGMPEDFQVHIKRDDMTGSVLSGNKVRKLEFLMADCLDQGCESIITCGGVFSNSCRAGAIAARQMGLDSHLFLWSESTDLPFTGNALLDRLVGCNFYLMPLDCPLETQVYPRMKLLQDHIQKTTNKKAYRLPFGGSNEVGVWGYIECFRELMGQGLLDRFTDIVIAAGSSGSVTGLAIANYLTGSKLKIHGFAACKDQMFFYDLGDKTLQSLGLQDADGAGVKAVDIMHIRDEVVGIGYAVNTSEELECIEQVAMNTGILVDPVYSGKATYHLLKLMNEKPGTFKGKQILFIHTGGVFDLFSGAVGSRLTKKGHKENKVYDWMDLSDKVPDKVSAAS

SEQ ID NO: 70 - DNA, 1155 bp, Strongylocentrotus purpuratus
  CDS (1)..(1155)
atgggtcacgtgttggagccaaataacgattaccccctcttgccatacgatgctcccgagtggacatcccgactcgctgtcatccccaagtatcgagttcagttggggtccctaggcacccctattcaacgatggcgcctcccaggcatgcccgatgacttccaggtccacatcaaacgagatgatatgacaggcagcgtactctcaggaaacaaggtaaggaagctagagttcttgatggctgactgcttggatcagggttgtgaatccatcataacctgtggtggtgtgttctcaaactcttgccgtgctggagccatcgctgcccgccaaatgggactggacagccatctcttcctctggtcagaatccacggatctgccgttcacggggaatgctttactggaccgcctggtgggctgtaacttctacctcatgccgttagactgccctctggagacggaagtatacccgcgcatgaagctacttcaagaccacatccagaaaacgaccaataagaaggcttacagactaccttttggaggatccaatgaggttggagtatggggctacatcgagtgcttccgtgaactaatgggccagggactcctggagagattcaccgacattgtaatcgcagccggtagcagcgggtctgtgaccggccttgccattgcaaactacctcaccggtagcaaactaaagatacacggctttgcagcatgcaaggaccaaatgtttttctacgacctcggcgacaagacgctccaatccctcgggctacaggacgccgacggcacaggtgtgaaagcggtcgacatcatgcacattcgtgatgaagtagtcggcatcgggtatgccgtgaacacttcagaagaattagaatgcatcgagcaggtggcgatgaacaccgggattcttgtggaccctgtctactccggcaaggccacctatcatctactcaaactcatgaacgagaaaccaggaacgttcaagggcaagcagatcctcttcatacatacaggtggtgtctttgacctgttcagcggtgccgttggttctcggctcacaaagaaaggccataaagaaaacaaagtctacgactggatggacctctccgacaaagtcccagacaaggtctcagctgcatcctag

SEQ ID NO: 71 - protein, 384 aa, Strongylocentrotus purpuratus
MGHVLEPNNDYPLLPYDAPEWTSRLAVIPKYRVQLGSLGTPIQRWRLPGMPDDFQVHIKRDDMTGSVLSGNKVRKLEFLMADCLDQGCESIITCGGVFSNSCRAGAIAARQMGLDSHLFLWSESTDLPFTGNALLDRLVGCNFYLMPLDCPLETEVYPRMKLLQDHIQKTTNKKAYRLPFGGSNEVGVWGYIECFRELMGQGLLERFTDIVIAAGSSGSVTGLAIANYLTGSKLKIHGFAACKDQMFFYDLGDKTLQSLGLQDADGTGVKAVDIMHIRDEVVGIGYAVNTSEELECIEQVAMNTGILVDPVYSGKATYHLLKLMNEKPGTFKGKQILFIHTGGVFDLFSGAVGSRLTKKGHKENKVYDWMDLSDKVPDKVSAAS

SEQ ID NO: 72 - DNA, 1017 bp, Neurospora crassa N150
  CDS (1)..(1017)
atggccgacttactactccccgaaccgttcgccagcatccctcgggagccgctaacctttggaccttctccgatccagcctctcccccgcatctcccaagccctcggtggaaaggtcaacgtctttgctaaacgcgaggacctcaactccggtcttgcctttggaggcaacaagaccagaaagctagagtatatcccaccacccgccctcgccgccgccgcctccaagctcggcctgcacgccgctctcgtccaagaacactgggtccccgactggaccgatcccggctacgacaaagtcggcaacatccagctctcccggctgatgggggccgacgtccgtcttgaaccgctagccgggttcgggatcgagcacaagcagacgctggcgaaactcaaagatgatctggagaaggaggggagaaagccgtattatatcccggctggggcgtcggatcaccctcttggagggctggggttcgcgaggtgggcgtttgaggtggtggcgcaggaggaggagttggggattcatttcgacacggtggtggtctgtgcggtgacagggtcgacgatggcgggcatggtggccgggtttaagttggttgagatgttggaacgccactcggaaaggctgggcaaggtgaataagaggagggtgattgggattgatgcgtccgccaaggttgagcagacgagagcgcaggtgctgaggattgcgaaacagacagcggccaagattgggttgaaggaggaggatatcacggagtcggatatcgtgctggatgatcggtaccatgcgggggtttatggcgtgccggacgagaaaacgattgaggctatcaagtttggggcgcggacggaggcgttcattaccgatcccgtgtatgagggcaaaagtctggcgggcatgatggacatgattaagaatggggagattgaggcgggaagcaatgtgctgtatgcgcaccttggagggcaattggcactgaatgcgtactccgctttggggttggaataa

SEQ ID NO: 73 - protein, 338 aa, Neurospora crassa
  Neurospora crassa N150
MADLLLPEPFASIPREPLTFGPSPIQPLPRISQALGGKVNVFAKREDLNSGLAFGGNKTRKLEYIPPPALAAAASKLGLHAALVQEHWVPDWTDPGYDKVGNIQLSRLMGADVRLEPLAGFGIEHKQTLAKLKDDLEKEGRKPYYIPAGASDHPLGGLGFARWAFEVVAQEEELGIHFDTVVVCAVTGSTMAGMVAGFKLVEMLERHSERLGKVNKRRVIGIDASAKVEQTRAQVLRIAKQTAAKIGLKEEDITESDIVLDDRYHAGVYGVPDEKTIEAIKFGARTEAFITDPVYEGKSLAGMMDMIKNGEIEAGSNVLYAHLGGQLALNAYSALGLE

SEQ ID NO: 74 - DNA, 999 bp, Desulfovibrio vulgaris
  Desulfovibrio vulgaris subsp. vulgaris str. Hildenborough
  CDS (1)..(999): transl_table=11
atgaatctcgctgtttttcccagacgtggctatgtcaaggaccccacccccatcgaatcgtgtccggctttttcgaaggctctgggcggcaaggtcaacatcttcatcaagcgtgatgacctgctgcccggctgcgccgggggcaacaagacccgcaagctggacttctgcatggcggatgccctcgccaagggcgctgacaccatcatcacctgcggggccgtgcagtccaaccattgccgcctgaccctgtcgtgggctgtcaaggaagggctcgactgccatctcgtccttgaggagcgtgtcaagggcagctacaagcccgaagcttcgggcaacaacttcctgttcaagctcatgggtgtgaagagcatcaccgtcgtgcccggcggttccaacatgatgggggaaatggaagcactcgctgcacgcctcaaggaagcagggcgtactccctacatcatccccggtggagcatcgaaccccatcggggccaccggctatgtctcttgcgcgcaggagaccctccagcaactcttcgacatgggactcaaggtggatcacatggtggttcccagcggtagcgccgggacccatgccggcatcgtcgtcggcatggtgggcaacaacgccaacatccctgtctccggcatcaacgtgagccgcaccaaggccgaccaggaggcactggtgcgcaagctggcccgcgagacggcgcagcgcgtgggcatgagtggcgagttccccgatgaagcggtgacctgctttgacggttatgtgggccccggctattcgctgcccaccgagagcatggtcgaagccgtgcgtcttctggcccagaccgaaggcatactgctcgacccggtgtactcgggcaaggccatggccggtcttgtggacctcgtgcgtagcggctactttgccgaaggttcgaatgtgcttttcctgcacaccggtggatcgccagcgctttacgcctacctcgatacgttcaagtaa

SEQ ID NO: 75 - protein, 332 aa, Desulfovibrio vulgaris
  Desulfovibrio vulgaris subsp. vulgaris str. Hildenborough
MNLAVFPRRGYVKDPTPIESCPAFSKALGGKVNIFIKRDDLLPGCAGGNKTRKLDFCMADALAKGADTIITCGAVQSNHCRLTLSWAVKEGLDCHLVLEERVKGSYKPEASGNNFLFKLMGVKSITVVPGGSNMMGEMEALAARLKEAGRTPYIIPGGASNPIGATGYVSCAQETLQQLFDMGLKVDHMVVPSGSAGTHAGIVVGMVGNNANIPVSGINVSRTKADQEALVRKLARETAQRVGMSGEFPDEAVTCFDGYVGPGYSLPTESMVEAVRLLAQTEGILLDPVYSGKAMAGLVDLVRSGYFAEGSNVLFLHTGGSPALYAYLDTFK

SEQ ID NO: 76 - DNA, 996 bp, Bacillus thuringiensis
  Bacillus thuringiensis serovar konkukian str. 97-27
  CDS (1)..(996): transl_table=11
atgaatttagctaaattcccgagaaaaaaatatacagagtcatatacaccaattgaaaaattaaacaatttttctgaggcacttggtgggccgactatttattttaaacgagatgatttacttggtttaacagcaggcggtaataagacgagaaagttagagtttctagttgcggatgcacaggcaaaaggtgcggatacgttaattacagctggtggcattcagtccaatcattgccgtctaacactggcagcggcggtaaaagaaaaaatgaaatgtattcttgtattagaagaagggcttgagccagaagagaagcgagactttaacggaaactatttcttatatcatttactaggtgctgaaaatgtaattgttgtaccaaacggagcagatcttatggaagagatgcataaagtagcaaaagaagttagtgaaaaagggaatacaccatatgtaataccagttggtggatcgaatcctactggtgcaatgggatacgttgcttgtgcgcaagaaattatggcgcaatcatttgaccaaggaattgatttcagttcagtcgtttgcgtaagtggtagcggcggtatgcacgctggtttaattacaggttttgctggaacacaaagtaacatccccgtaatcggaattaacgtaagtagaggaaaagcagagcaagaagagaaagtagcaaaacttgtagatgaaacgtcagctcatgttggtattccaaactttatcccgcgcgaagcggttacatgctttgatgaatatgtaggaccaggttacgcgttaccaacgccagaaatggtggaagcagtgcagctgttagcgaaaacagaaggtattttacttgatccagtatatacaggtaaagcagtagcgggattaatcgacttaattagaaaaggtacatttaataaagaggacaacattttattcgtacattcaggtggttcaccagctttatatgcgaatacatctttatttgcgtaa

SEQ ID NO: 77 - protein, 331 aa, Bacillus thuringiensis
  Bacillus thuringiensis serovar konkukian str. 97-27
MNLAKFPRKKYTESYTPIEKLNNFSEALGGPTIYFKRDDLLGLTAGGNKTRKLEFLVADAQAKGADTLITAGGIQSNHCRLTLAAAVKEKMKCILVLEEGLEPEEKRDFNGNYFLYHLLGAENVIVVPNGADLMEEMHKVAKEVSEKGNTPYVIPVGGSNPTGAMGYVACAQEIMAQSFDQGIDFSSVVCVSGSGGMHAGLITGFAGTQSNIPVIGINVSRGKAEQEEKVAKLVDETSAHVGIPNFIPREAVTCFDEYVGPGYALPTPEMVEAVQLLAKTEGILLDPVYTGKAVAGLIDLIRKGTFNKEDNILFVHSGGSPALYANTSLFA

SEQ ID NO: 78 - DNA, 885 bp, Acinetobacter sp.
  Acinetobacter sp. ADP1
  CDS (1)..(885): transl_table=11
atgtttgactctatcgcccaagatattccatatcacacattaatcgatggctcacctgttcgtcttgatctcaagcgacttgatcttatccatccacacatttcaggcaacaagttttataaacttaaatacaatcttattgaagcaaaaaagcgcggttgtgatcgtattttgacttttggaggtgccttttccaatcatatcgcagccagtgcctatgccgcacatcattttgattttaaaagtatcggtattattcgtggtcaagagctggcgtatcgttctctcaatgcaacattaaaaactgcacagcactatggcatgcaacttgagtttatgtcacgtgagcaatatcgccaaaaagatcagtcagaatttttacatacgcttcaaagtcaatacccatctgcctttatcattccagaaggtggaacgaatgcacttgccatacaaggcagcaaagaaatcttgagtgatacagatcgactcaattatgatgtcatctgctgtgcggttggtactggtggtacactggctggactgattgaagccagccatcatgggcaatatgttataggtttctccgcactcaaaggagactttcttcacaatgatgtccagcgccataccaataaaaccaactggcatattctggatgattattgctttgggggatacgcaaaaacatcttctgaactgttcgactttatagctgggtttgaacaaaaatatcagattccactcgaacaggtatataccgccaaaatgctatatggactgctcgacctgattcagaaaaatgattttgatcaaggtacacgcatccttgctctgcatacaggcggtttacaaggacgtcgccatgacattggcgttacagaataa

SEQ ID NO: 79 - protein, 294 aa, Acinetobacter sp.
  Acinetobacter sp. ADP1
MFDSIAQDIPYHTLIDGSPVRLDLKRLDLIHPHISGNKFYKLKYNLIEAKKRGCDRILTFGGAFSNHIAASAYAAHHFDFKSIGIIRGQELAYRSLNATLKTAQHYGMQLEFMSREQYRQKDQSEFLHTLQSQYPSAFIIPEGGTNALAIQGSKEILSDTDRLNYDVICCAVGTGGTLAGLIEASHHGQYVIGFSALKGDFLHNDVQRHTNKTNWHILDDYCFGGYAKTSSELFDFIAGFEQKYQIPLEQVYTAKMLYGLLDLIQKNDFDQGTRILALHTGGLQGRRHDIGVTE

SEQ ID NO: 80 - DNA, 1014 bp, Erwinia carotovora
  Erwinia carotovora subsp. atroseptica SCRI1043
  CDS (1)..(1014): transl_table=11
atgcatcttgcccgattcccccgtttatcactgggtcatttccctacgccgttggaagtgttgccgaacctgtctgcttatctgggcgggccgacgatttatatcaaacgtgacgatgctacaggcttggcaactggcgggaataaaacccgcaagctggagttcctgttagccgatgcgcagcagcagggtgcggacgtcatcatcacacagggcgcgacacagtctaaccatgtgcggcaaaccattgcggcggcggcaaagctggggctgaaaaccaaagtgctattggaaaagcgcgtagaggattatggcgaagattatcagcgctccggtaacgtgctgttggataacctgcttggcggtgacattatcgatcaccttcctgcgggtacagacatgcagcaggcgatggaaacactggcggaatcgctgcgtaaagaaggatttaagccttatgttatccccggtggcggttccagtccggtaggcgcgttgggctatgttgcctgtgcggaagagctgttgttccagtctagccagcagcgcttacgcatcgatcatattgtgcatgcgacgggcagcacgggtacgcaggcgggattggttactgggctggcggcaacacacagccagatcccgctgttaggcatcagcgtcagagcgcccaaagcaaagcaggaggagaatgtttacgcgttagcgcagcgcacctggcaactgctgggcattccgggcgaactgccgcgcagcgccgtacgggtgaacagcgactacgttggcaaaggctatggcattcccactgaaggaacgttagaagcgctcaggctgttggcgcagttggaagggattttgctcgatccggtctattcaggaaaagggatggcgggactgatcgatttaatccgtcaggggcattttcgcgccgatgaaaacatcgtctttattcataccggtggctcagcggggctgtttggctaccgccaactgttcgaacaaacggcagcacaatga

SEQ ID NO: 81 - protein, 337 aa, Erwinia carotovora
  Erwinia carotovora subsp. atroseptica SCRI1043
MHLARFPRLSLGHFPTPLEVLPNLSAYLGGPTIYIKRDDATGLATGGNKTRKLEFLLADAQQQGADVIITQGATQSNHVRQTIAAAAKLGLKTKVLLEKRVEDYGEDYQRSGNVLLDNLLGGDIIDHLPAGTDMQQAMETLAESLRKEGFKPYVIPGGGSSPVGALGYVACAEELLFQSSQQRLRIDHIVHATGSTGTQAGLVTGLAATHSQIPLLGISVRAPKAKQEENVYALAQRTWQLLGIPGELPRSAVRVNSDYVGKGYGIPTEGTLEALRLLAQLEGILLDPVYSGKGMAGLIDLIRQGHFRADENIVFIHTGGSAGLFGYRQLFEQTAAQ

SEQ ID NO: 82 - DNA, 999 bp, Desulfotalea psychrophila
  Desulfotalea psychrophila LSv54
  CDS (1)..(999): transl_table=11
atgaatctcacccaattcccaagaagaaattatctccaaggacctactcctattgaagcagccccaaggttttctaaggccctgggtggtaaggtaaatgttttcatcaagcgtgatgacctgttgcccggttgtgccggtggtaataagaccagaaaattggatttttgtattgctgatgcgatagagaagggcgctgatacgattattacctgtggtcctgttcagtctaatcactgtcgtttgaccctttcttgggcagttaaggaagagatggattgtcatcttatacttgaagagcgtgttccgggaagctataaagaagatggttccggtaacaacttccttttcaatctgatgggcgtaaagagcactcaggttgttcctggtggttccgatatgatgggtgagatggagaagcttgccaaggagcttgaggctcagggcaaaaaaccttatatcattccaggcggtgcctctaacgttcttggcgcgaccggttatgttgcctgtgcccaggaaattcaacaacagctctttcaacaaaacattaatataactgatatagtagtcccgagtggtagcgccggtacccatgcaggtgtcgccgtcggtatgtacggaattaattccggtattagggtaagcggtatcaatgtaagtaagcctaaggatgtccaggaagagaatgtttataagttggcatacgaaactgcaaaagcagtaggtgtgtgcggagagcttccacgcggtgagataacctgttttgatggctatgtaggtgcaggttattctctgcccaccgattcaatggttgaggcagtaaagcttcttgctcgaactgaggcaatcctgcttgatcctgtttattccggcaaggttatggctggtatgatcgaccttattcgaaacgattatttcgctccaggaacaaatgttttatttctgcataccggtggatctcccgccctctatgcatataccgatacgtttaaatag

SEQ ID NO: 83 - protein, 332 aa, Desulfotalea psychrophila
  Desulfotalea psychrophila LSv54
MNLTQFPRRNYLQGPTPIEAAPRFSKALGGKVNVFIKRDDLLPGCAGGNKTRKLDFCIADAIEKGADTIITCGPVQSNHCRLTLSWAVKEEMDCHLILEERVPGSYKEDGSGNNFLFNLMGVKSTQVVPGGSDMMGEMEKLAKELEAQGKKPYIIPGGASNVLGATGYVACAQEIQQQLFQQNINITDIVVPSGSAGTHAGVAVGMYGINSGIRVSGINVSKPKDVQEENVYKLAYETAKAVGVCGELPRGEITCFDGYVGAGYSLPTDSMVEAVKLLARTEAILLDPVYSGKVMAGMIDLIRNDYFAPGTNVLFLHTGGSPALYAYTDTFK

SEQ ID NO: 84 - DNA, 1035 bp, Desulfotalea psychrophila
  Desulfotalea psychrophila LSv54
  CDS (1)..(1035): transl_table=11
ttgttaaataaatttttcataaaggataaaaaaatcatgaatctcacacaattcccaagaagaaattatctccaaggacctactcctattgaagctgcaccaaggttttctaaggccctgggtggtaaggtaaatgtttttattaagcgtgatgatctgttgcctggttgtgctggtggtaataagactagaaaattagatttttgtattgctgatgcgatagagaagggcgctgatacgattattacctgtggtgctgttcagtctaatcactgccgtttgaccctttcttgggcagttaaggaagagatggattgtcatcttatacttgaagagcgtgttcctggaagctataaaaaagatggttccggtaacaactttcttttcaatctgatgggcgtaaagagcactcaggttgtttctggtggttccgatatgatgggtgagatggaaaagcttgccaaggagcttgaggctcagggcaaaaaaccttatatcattccaggcggagcctctaatgctattggagcaaccggttatgttgcctgtgcccaggaaattcagcaacagctttttgagcaaaacattaatataactgatatagttgtcccgagtggtagtgccggtacccatgctggtgttgccgttggtatgtacggaattaattcgggtattacagtaagtggtatcaatgtaagtaagcctaaggctgtccaggaagagaatgtttataaattggccaaggaaactgcaaaaagagtaggtgtccgcggagagtttccacgcgatgagataacctgttttgatggctatgtcggtgcagggtattcgttgcccaccgattcaatggttgaggctgtaaagcttcttgctcgaactgaggcaatcctgcttgatcctgtttattccggcaaggttatggctggtatgatcgaccttattcgaaacgattattttgccccgggggcaaatgttttatttctgcataccggtggatctcccgccctctatgcatataccgacacgtttaagtaa

SEQ ID NO: 85 - protein, 344 aa, Desulfotalea psychrophila
  Desulfotalea psychrophila LSv54
MLNKFFIKDKKIMNLTQFPRRNYLQGPTPIEAAPRFSKALGGKVNVFIKRDDLLPGCAGGNKTRKLDFCIADAIEKGADTIITCGAVQSNHCRLTLSWAVKEEMDCHLILEERVPGSYKKDGSGNNFLFNLMGVKSTQVVSGGSDMMGEMEKLAKELEAQGKKPYIIPGGASNAIGATGYVACAQEIQQQLFEQNINITDIVVPSGSAGTHAGVAVGMYGINSGITVSGINVSKPKAVQEENVYKLAKETAKRVGVRGEFPRDEITCFDGYVGAGYSLPTDSMVEAVKLLARTEAILLDPVYSGKVMAGMIDLIRNDYFAPGANVLFLHTGGSPALYAYTDTFK

SEQ ID NO: 86 - DNA, 993 bp, Yersinia pseudotuberculosis
  Yersinia pseudotuberculosis IP 32953
  CDS (1)..(993): transl_table=11
gtgacgcttcaacacaaactgacgcaattcccgcgtctcgatctggtcggtaatgcgacgccattagaaaagctgtctcgtctatctgattatctgggacgtgaaatttacattaaacgtgatgatgtcacgcctgtggcgcttggcgggaataaactgcgcaagctagaattcttagccgcagatgccttgagacagggagccgatacgctggttacggctggtgctattcaatctaatcatgtccgccaaaccgccgccgtggccgcgaaactggggctgcattgcgttgcgctgttggaaaaccccattggtactgagcaggcaaactatctgaccaatgggaaccggctgttactggacctattcaatgttgatgttgtgatgtgtgaggcattgaacgatccaaatcagcaattagcagaattggctacccgcgtggaagcgcagggtttccgcccatatgtggtaccgattggcggttctaatgccttgggcgcgctgggttatgtgcagtgctcactggaaattgctgctcaagccgcgggcaatgttgcgtttagttcggtcgtcgtggcctctggcagtgcgggaacacatgcaggattggcggttggtctacagcagttgttacccgatgcggaattaatcggtgtgacggtatcacgtagtgccgatgaacagcggcctaaagtggcacagattcaacaagcgttggcgacatcattagggatgacggacccattggcaaaaatcaccttgtgggatagttattttgccccgcaatatgggatgccaaacgaagaggggatagcggctattaagctcttggcaagactggaaggaatattgttggaccctgtgtataccggtaaggcgatggcgggcttacttgatggtattgaacagcaaaaattctgcgacaaagggccaattttatttatccacactggcggggcacctgcgctgtttgcttatcatccgcaggtgtag

SEQ ID NO: 87 - protein, 330 aa, Yersinia pseudotuberculosis
  Yersinia pseudotuberculosis IP 32953
MTLQHKLTQFPRLDLVGNATPLEKLSRLSDYLGREIYIKRDDVTPVALGGNKLRKLEFLAADALRQGADTLVTAGAIQSNHVRQTAAVAAKLGLHCVALLENPIGTEQANYLTNGNRLLLDLFNVDVVMCEALNDPNQQLAELATRVEAQGFRPYVVPIGGSNALGALGYVQCSLEIAAQAAGNVAFSSVVVASGSAGTHAGLAVGLQQLLPDAELIGVTVSRSADEQRPKVAQIQQALATSLGMTDPLAKITLWDSYFAPQYGMPNEEGIAAIKLLARLEGILLDPVYTGKAMAGLLDGIEQQKFCDKGPILFIHTGGAPALFAYHPQV

SEQ ID NO: 88 - DNA, 996 bp, Bacillus cereus
  Bacillus cereus E33L
  CDS (1)..(996): transl_table=11
atgaatttagctaaattcccgagaaaaaaatatacagagtcatatacaccaattgaaaaattaaacaatttttcagaagcacttggtgggccgactatttattttaaacgagatgatttacttggtttaacagctggtggtaataagacgagaaagttagagtttttagttgcggatgcacaggcaaagggtgcagatacgttaattacagctggtggtattcagtcaaatcattgccgcctaacacttgcagcggcggtaaaagaaaaaatgaaatgtatccttgtattagaagaagggcttgagccagaagagaagccagactttaatggaaactatttcttatatcatttactaggtgctgaaaatgtaattgttgtacgaaacggagcagatcttatggaagagatgcataaagtcgcgaaagaagttagtgaaaaagggaatacaccatatgtcattccggtcggtggatcgaatcctactggcgcaatgggatacgttgcttgtgcgcaagaaattatggtgcaatcatttgaccaaggaattgatttcagttcagtcgtttgcgtaagtggtagtggcggtatgcacgctggtttaattacaggttttgctggaacacaaagtaacatccccgtaatcggaattaacgtaagtagaggaaaagcagagcaagaagagaaagtagcaaaacttgtagatgaaacgtcagctcatgttggtattccaaactttatcccgcgcgaagcggttacatgctttgatgaatatgtaggaccaggttacgcgttaccaacgccagaaatggtggaagcagtgcagctgttagcaaaaacagaaggtattttacttgatccagtatatacaggtaaagcagtagcgggattaatcgacttaattagaaaaggtacatttaataaagaggacaacattttattcgtacattcaggtggttcaccagctttatatgcgaatacatctttatttgcgtaa

SEQ ID NO: 89 - protein, 331 aa, Bacillus cereus
  Bacillus cereus E33L
MNLAKFPRKKYTESYTPIEKLNNFSEALGGPTIYFKRDDLLGLTAGGNKTRKLEFLVADAQAKGADTLITAGGIQSNHCRLTLAAAVKEKMKCILVLEEGLEPEEKPDFNGNYFLYHLLGAENVIVVRNGADLMEEMHKVAKEVSEKGNTPYVIPVGGSNPTGAMGYVACAQEIMVQSFDQGIDFSSVVCVSGSGGMHAGLITGFAGTQSNIPVIGINVSRGKAEQEEKVAKLVDETSAHVGIPNFIPREAVTCFDEYVGPGYALPTPEMVEAVQLLAKTEGILLDPVYTGKAVAGLIDLIRKGTFNKEDNILFVHSGGSPALYANTSLFA

SEQ ID NO: 90 - DNA, 1020 bp, Burkholderia mallei
  Burkholderia mallei ATCC 23344
  CDS (1)..(1020): transl_table=11
atgaacacgacgacgctctcgacgaaactgaacgccttcgcccgcctgaacctgatcgacgcgccgacgccgctgcagtacttgccgcgcctgtccgcgcacgtcggccgcgacatccacgtgaagcgcgacgactgcacgccgctcgcgatgggcggcaacaagctgcgcaagctcgaattcctcgccgcggacgcgctcggccaaaacgcggacgtgctggtgaccgcgggcgcgatccagtcgaatcacgtccggcagacggccgcgctcgtcgcgcagctcggcctcggctgtgtcgcgctgctcgaaaacccgatcgcagccgcgcgcgacgattatctgcaaagcggcaaccggctgctgctcgatctgttcgacgtgcgcgcgcacgtcgtcgacgggctcgacgacgtcgaccggcaactcgaagccgccgcgcggcggctgcgcgacgaagggcggcgcccgtacgtgatcccgatcggcggatcgaatccgctcggcgcgctcggctacgtgcgcgcgggcctcgagctcgcgcagcagatccgcgcggccgagcgcgatttcgcggctgtcgtgctcgcgtccggcagcgccggcacgcacgcgggcctcgcgttcgcgctcgcgcacgcgttgcccgggctgccggtgatcggcgtgacggtatcgcgcaccgacgcgcagcagcgcccgaaggtgcggcatctgctcgacggcatgagcgggctgctcgacgtcgcgttgccggcgggcgcgcgcatcgatctgtgggacgactacttcgcgccgcgctacggcgagcccaatcgcgcgggcatcgacgcgctgcggctgctcgcgcgaaccgaggggctgctgctcgatccggtgtacacgggcaaggcgatggcgggtctcatcgacggcgtcgcgcgcggccgcttcgacggaaacggcccggtgctgttcgtgcatacgggcggcgcgcccgcgctgttcgcgtatcaggacacgtgccgcgcgagccgatga

SEQ ID NO: 91 - protein, 339 aa, Burkholderia mallei
  Burkholderia mallei ATCC 23344
MNTTTLSTKLNAFARLNLIDAPTPLQYLPRLSAHVGRDIHVKRDDCTPLAMGGNKLRKLEFLAADALGQNADVLVTAGAIQSNHVRQTAALVAQLGLGCVALLENPIAAARDDYLQSGNRLLLDLFDVRAHVVDGLDDVDRQLEAAARRLRDEGRRPYVIPIGGSNPLGALGYVRAGLELAQQIRAAERDFAAVVLASGSAGTHAGLAFALAHALPGLPVIGVTVSRTDAQQRPKVRHLLDGMSGLLDVALPAGARIDLWDDYFAPRYGEPNRAGIDALRLLARTEGLLLDPVYTGKAMAGLIDGVARGRFDGNGPVLFVHTGGAPALFAYQDTCRASR

SEQ ID NO: 92 - DNA, 1020 bp, Burkholderia pseudomallei
  Burkholderia pseudomallei K96243
  CDS (1)..(1020): transl_table=11
atgaacacgacgacgctctcgacgaaactgaacgccttcgcccgcctgaacctgatcgacgcgccgacgccgctgcagtacttgccgcgcctgtccgcgcacgtcggccgcgacatccacgtgaagcgcgacgactgcacgccgctcgcgatgggcggtaacaagctgcgcaagctcgaattcctcgccgcggacgcgctcggccaaaacgcggacgtgctggtgaccgcgggcgcgatccagtcgaatcacgtccggcagacggccgcgctcgccgcgcagctcggcctcggctgtgtcgcgctgctcgaaaacccgatcgcagccgcgcgcgacgattatctgcaaagcggcaaccggctgctgctcgatctgttcgacgtgcgcgcgcacgtcgtcgacgggctcgacgacgtcgaccggcaactcgaagccgccgcgcggcggctgcgcgacgaagggcggcgcccgtacgtgatcccgatcggcggatcgaatccgctcggcgcgctcggctacgtgcgcgcgggcctcgagctcgcgcagcagatccgcgcggccgagcgcgatttcgcggctgtcgtgctcgcgtccggcagcgccggcacgcacgcgggcctcgcgttcgcgctcgcgcacgcgttgcccgggctgccggtgatcggcgtgacggtatcgcgcaccgacgcgcagcagcgcccgaaggtgcggcatctgctcgacggcatgagcgggctgctcgacgtcgcgttgccggcgggcgcacgcatcgatctgtgggacgactacttcgcgccgcgctacggcgagcccaatcgcgcgggcatcgacgcgctgcggctgctcgcgcgaaccgaggggttgctgctcgatccggtgtacacgggcaaggcgatggcgggtctcatcgacggcgtcgcgcgcggccgcttcgacggaaacggcccggtgctgttcgtgcatacgggcggcgcgcccgcgctgttcgcgtatcaggacgcgtgccgcgcgagccgatga

SEQ ID NO: 93 - protein, 339 aa, Burkholderia pseudomallei
  Burkholderia pseudomallei K96243
MNTTTLSTKLNAFARLNLIDAPTPLQYLPRLSAHVGRDIHVKRDDCTPLAMGGNKLRKLEFLAADALGQNADVLVTAGAIQSNHVRQTAALAAQLGLGCVALLENPIAAARDDYLQSGNRLLLDLFDVRAHVVDGLDDVDRQLEAAARRLRDEGRRPYVIPIGGSNPLGALGYVRAGLELAQQIRAAERDFAAVVLASGSAGTHAGLAFALAHALPGLPVIGVTVSRTDAQQRPKVRHLLDGMSGLLDVALPAGARIDLWDDYFAPRYGEPNRAGIDALRLLARTEGLLLDPVYTGKAMAGLIDGVARGRFDGNGPVLFVHTGGAPALFAYQDACRASR

SEQ ID NO: 94 - DNA, 987 bp, Salmonella enterica
  Salmonella enterica subsp. enterica serovar Paratyphi A str. ATCC
  CDS (1)..(987): transl_table=11
atgccactacatcacttaacgcgcttccctcgcctggagcttattggcgcgccgaccccgctcgaatacctgccgcgattgtctgattatcctggccgtgagatttacattaagcgcgatgacgttacgcccattgcaatgggcggtaataaactgcgtaagctggagtttctggtggccgacgcgctgcgagaaggggcggatacgctgataaccgcaggggcgattcagtcgaaccatgtccgtcagacggcggcagtcgcggccaaattgggactgcattgcgtcgccttgctggaaaatccaatcggtaccaccgcggaaaattacctgacgaatggtaatcgcctgttactggatttatttaatacgcaaattgagatgtgcgatgtgctaaccgatccggatgcgcagctgcaaacgctggcgacgcgcattgaagcgcaagggttcaggccctatgtgattccggtcggcggctccagcgcgctgggcgcaatgggatacgtagagagcgccctggaaatcgcccagcagtgtgaagaagtcgtcgggctctcttcggtggtggtggcctccggcagcgccggaacgcacgccgggttagctgtcgggctggaacatctgatgcctgacgtcgaactgattggcgtgaccgtttcacgttctgtcgccgagcagaaacccaaagtgattgccttgcagcaggctattgccggtcagctggcgctgacggcgacggcggatattcatttatgggatgactattttgccccgggttacggcgtgccaaatgacgcggggatggaggcggtgaaactgctggcgagcctggagggggtgttgctggatccggtatataccggcaaagcgatggcgggtctgatagacggcatcagccagaaacgctttaacgatgacgggccgattctctttattcacaccggtggggcgcctgcgctgtttgcctaccatcctcatgtataa

SEQ ID NO: 95 - protein, 328 aa, Salmonella enterica
  Salmonella enterica subsp. enterica serovar Paratyphi A str. ATCC
MPLHHLTRFPRLELIGAPTPLEYLPRLSDYPGREIYIKRDDVTPIAMGGNKLRKLEFLVADALREGADTLITAGAIQSNHVRQTAAVAAKLGLHCVALLENPIGTTAENYLTNGNRLLLDLFNTQIEMCDVLTDPDAQLQTLATRIEAQGFRPYVIPVGGSSALGAMGYVESALEIAQQCEEVVGLSSVVVASGSAGTHAGLAVGLEHLMPDVELIGVTVSRSVAEQKPKVIALQQAIAGQLALTATADIHLWDDYFAPGYGVPNDAGMEAVKLLASLEGVLLDPVYTGKAMAGLIDGISQKRFNDDGPILFIHTGGAPALFAYHPHV

SEQ ID NO: 96 - DNA, 1020 bp, Silicibacter pomeroyi
  Silicibacter pomeroyi DSS-3
  CDS (1)..(1020): transl_table=11
atgcatcttgcccgctatccccgccgcttcatcgcccatctgccgacgccgctggaacggctggaccggctgaccgccgaactgggcgggcccgagatctggatcaagcgcgacgactgcaccggcctgtccaccggcggcaacaagacccgcaagctggaattcctgatggccgaggccgagctgcaaggcgctgacatggtgatgacgcagggcgcgacccagtccaaccatgcccgccagaccgccgcattcgccgccaagctgggcatggattgccatatcctgctcgaggaccggaccggctcgaacaacgccaactacaacaacaacggcaacgttctgctcgaccatctgcatggcgccaccactgaaaagcgccccggcagcggtctggacatgaatgccgagatggaaaaggtggccgagaagttccgcgccgacgggcgcaaggtctataccatccccggcggcggctcgaacccgaccggcgcgctgggatatgtcaactgcgctttcgagatgctgaaccagttcaatgagcgcgggctgaaggtggaccatatcgtgcatgccaccggcagcgcgggcacccaggcagggctgatcaccgggcttcaggcgatgaacgctcagatcccgctcttgggcatcggcgtgcgtgcgcccaagcccaagcaggaagagaatgtctataacctggcctgcgccaccgccgagaagctgggttgccccggtgtcgtcgcgcgcgaggacgtggtggccaataccgactatgtcggcgaaggctatggcatcccgaccgaaagcgggctggaggcgatccgcatgttcgccgagcttgaggcgatcctgcttgacccggtctattcggccaagggcgcggctggcttcatcgacctgatccgcaagggtcatttcaaaaagggcgagcgggtggtgttcctgcataccggcggcgctgtggcgctgttcggctatgacaacgcctttgactattcgggacgctgggtggcctaa

SEQ ID NO: 97 - protein, 339 aa, Silicibacter pomeroyi
  Silicibacter pomeroyi DSS-3
MHLARYPRRFIAHLPTPLERLDRLTAELGGPEIWIKRDDCTGLSTGGNKTRKLEFLMAEAELQGADMVMTQGATQSNHARQTAAFAAKLGMDCHILLEDRTGSNNANYNNNGNVLLDHLHGATTEKRPGSGLDMNAEMEKVAEKFRADGRKVYTIPGGGSNPTGALGYVNCAFEMLNQFNERGLKVDHIVHATGSAGTQAGLITGLQAMNAQIPLLGIGVRAPKPKQEENVYNLACATAEKLGCPGVVAREDVVANTDYVGEGYGIPTESGLEAIRMFAELEAILLDPVYSAKGAAGFIDLIRKGHFKKGERVVFLHTGGAVALFGYDNAFDYSGRWVA

SEQ ID NO: 98 - DNA, 1158 bp, Silicibacter pomeroyi
  Silicibacter pomeroyi DSS-3
  CDS (1)..(1158): transl_table=11
atgggcagcatgcaaattcggcattattcaaaccgatttctcctctctaccctgagaaaaaatatgccaatccaggggggcatcgtgaagacgtttgtggatgcgcccgtttcaggggcggtggacgatcaggcattgctgcgccgcgcattggagcggttcgcgcgtatccgcctggggcatctgccgagtccgctggaaccgctggaccggctgagcgaggcgcttggcggtccgcgcatctgggtcaagcgcgacgactgcaccggcctgtccagcggcggcaacaagacccgcaagctggaattcctgatggcaagcgcgtgcgaggccggcgccgacacgatcatcacccagggcgcgatccagtccaaccatgcccgccagaccgccgccgccgcggcgcggctgggcctgcattgccacctgttgctggaagaccggaccggcgccgcggacctggcctataccctgaacggcaatgtgctgcttgaccggttgcacggcgccacgatctcgcgacgggccggcgggtcggacatggcggccgagatggagcggctggccgcgacgttgaggggcaagggcaagcgcccctatgtcattcccggcggcggatcgaaccgggtgggtgcccttggctatgtcaattgcgcgctggaactgagcgaacaggccctgagcatgggcctggacatcgacgcgctgatccatgcgacgggcagttgcggcacgcaggccggcctggtcgcgggcctggccggcctgtcctggaacacccatctgctggggatcggcgtgcgcgcgccgcaggagcggcaagaggccatggtctttgatctggcctgcgagaccatggattaccttggcatgggaataccgatcgtgcgctcgggcgtgcgggccaattgcgaccatgtcgggccgggctatggcctgccgaccgaggccatgtgcgaggcggtcaggatgctggcgcggctcgagggtctgctgcttgacccggtctataccggcaaggccatggcgggcctgatcgacctgacacggcagggatatttcgacgggatggcgaatatcgtcttcctgcataccggcggcagtgcggcgcttttcgggtatccggaaatcttcggactgccgggataccaaccataa

SEQ ID NO: 99 - protein, 385 aa, Silicibacter pomeroyi
  Silicibacter pomeroyi DSS-3
MGSMQIRHYSNRFLLSTLRKNMPIQGGIVKTFVDAPVSGAVDDQALLRRALERFARIRLGHLPSPLEPLDRLSEALGGPRIWVKRDDCTGLSSGGNKTRKLEFLMASACEAGADTIITQGAIQSNHARQTAAAAARLGLHCHLLLEDRTGAADLAYTLNGNVLLDRLHGATISRRAGGSDMAAEMERLAATLRGKGKRPYVIPGGGSNRVGALGYVNCALELSEQALSMGLDIDALIHATGSCGTQAGLVAGLAGLSWNTHLLGIGVRAPQERQEAMVFDLACETMDYLGMGIPIVRSGVRANCDHVGPGYGLPTEAMCEAVRMLARLEGLLLDPVYTGKAMAGLIDLTRQGYFDGMANIVFLHTGGSAALFGYPEIFGLPGYQP

SEQ ID NO: 100 - DNA, 987 bp, Salmonella enterica
  Salmonella enterica subsp. enterica serovar Choleraesuis str
  CDS (1)..(987): transl_table=11
atgccactacatcacttaacgcgctttcctcgcctggagcttattggcgcgccgaccccgctcgaatacctgccgcgattgtctgattatcttggccgtgagatttacattaagcgcgatgacgttacgcccattgcaatgggcggcaataaactgcgtaagctggagtttctggtggccgacgcgctgcgagaaggggcggatacgctgataaccgcaggggcgattcagtcgaaccatgtccgtcagacggcggcagtcgcggccaaattggggctgcattgcgtcgccttgctggaaaatccaatcggtaccactgcggaaaattacctgacgaatggtaatcgcctgttactggatttatttaatacacaaattgagatgtgcgatgcgctgaccgatccggatgcgcagctgcaaacgctggcgacgcgcattgaagcgcaagggttcaggccctatgtgatcccggtcggcggctccagcgcgctgggcgcaatgggatacgtagagagcgccctggaaatcgcccagcagtgtgcagaggtcgtcgggctctcttcggtggtggtggcctccggcagcgccggaacgcacgccgggttagctgtcgggctggaacatctgatgccggatgtcgaactgattggcgtgactgtttcacgttctgtcgccgagcagaaacccagagtgatttccttgcagcaggctattgccggtcagctggcgctgacggcgacggcggatattcatttatgggatgactattttgccccgggttacggcgtgccaaatgacgcggggatggaggcggtgaaactgctggcgagcctggagggggtgttgctggatccggtatataccggcaaagcgatggcgggtctgatagacggcatcagccagaaacgctttaacgatgacgggccgattctctttattcacaccggtggggcgcctgcgctgtttgcctaccatcctcatgtataa

SEQ ID NO: 101 - protein, 328 aa, Salmonella enterica
  Salmonella enterica subsp. enterica serovar Choleraesuis str
MPLHHLTRFPRLELIGAPTPLEYLPRLSDYLGREIYIKRDDVTPIAMGGNKLRKLEFLVADALREGADTLITAGAIQSNHVRQTAAVAAKLGLHCVALLENPIGTTAENYLTNGNRLLLDLFNTQIEMCDALTDPDAQLQTLATRIEAQGFRPYVIPVGGSSALGAMGYVESALEIAQQCAEVVGLSSVVVASGSAGTHAGLAVGLEHLMPDVELIGVTVSRSVAEQKPRVISLQQAIAGQLALTATADIHLWDDYFAPGYGVPNDAGMEAVKLLASLEGVLLDPVYTGKAMAGLIDGISQKRFNDDGPILFIHTGGAPALFAYHPHV

SEQ ID NO: 102 - DNA, 999 bp, Pseudomonas syringae
  Pseudomonas syringae pv. syringae B728a
  CDS (1)..(999): transl_table=11
atgatcaaacatcagcttgcccgcttcaatcgcctggacctgatcagcgcgccaacggctctggaaaagctcgagcgcctgtcgatctgggcagatcgtgatatctacatcaagcgggatgacaccacaacgctggccctgggcggcaacaaagtgcgcaaactcgagtacctggccgccgatgcgctggcccagggtgccgatacactgatcaccgccggtgccatccagtccaaccatgtccgtcagaccgctgccctggccgcgcgtctgggccttggctgtgtggcgctgctggaaaatcccatcggcaccgaagaccccagctacctgaaaaacggcaatcgcctgctgctcgaactgttcgatgccaaggtagagctggtggaaaacctcgacaacgctgacgaacaactgcatgccctggctgcacgcctgcgctccagtggcaaaaagccttatctggtccccatcggaggctcaagcccggtgggtgcgctgggttatgtgcgcgccgggctggaactggccgagcagatcaagcagaccggcatcgagtttgcggctgtcgttctggcctccggcagtgccggcacgcacagcggcctggcgttggcactggctcacgagctgccgcaattgccggtcatcggtgtgaccgtgtcgcgcagtgaagaagcacagctgcccaaggtccagggcctggccgagcgcaccgcagagttgctcggcgttgcgctgcctgaacacttcaaggtcgaactgtgggatgagtatttcgccccgcgatatggtgaaccgaacgccggtacgctgtcagccatcaagctggtggccagccacgaaggactgttgcttgacccggtctacaccggcaaggccatgtccggtctgctcgatggcatcggccgtcaacgcttcaacgacggcccgctgatcttcctgcacaccggcggtgcgccagcgctgtttgcctatccggatgcgttcgaccagtga

SEQ ID NO: 103 - protein, 332 aa, Pseudomonas syringae
  Pseudomonas syringae pv. syringae B728a
MIKHQLARFNRLDLISAPTALEKLERLSIWADRDIYIKRDDTTTLALGGNKVRKLEYLAADALAQGADTLITAGAIQSNHVRQTAALAARLGLGCVALLENPIGTEDPSYLKNGNRLLLELFDAKVELVENLDNADEQLHALAARLRSSGKKPYLVPIGGSSPVGALGYVRAGLELAEQIKQTGIEFAAVVLASGSAGTHSGLALALAHELPQLPVIGVTVSRSEEAQLPKVQGLAERTAELLGVALPEHFKVELWDEYFAPRYGEPNAGTLSAIKLVASHEGLLLDPVYTGKAMSGLLDGIGRQRFNDGPLIFLHTGGAPALFAYPDAFDQ

SEQ ID NO: 104 - DNA, 945 bp, Pseudomonas syringae
  Pseudomonas syringae pv. syringae B728a
  CDS (1)..(945): transl_table=11
atgatgctcgacgccctcggctggcaacccactgctcccctggaacgcttgaacctgccctggctgcaagacaccggggtcgaggttgcgatcctgcgcctggaccttatcgacgcgctgatcagcggtaacaaatggttcaagctcagcgagcacctcagtctggctgttgattcgggtgccgaggggttgatcagcctcggcggcgcacattccaatcatctgcatgccctggccgctgcaggcaaacgcttcggtttcccgacggtcggcctgttgcgcggtcatacccagcagacgccaacggtgctcgatctgcaggctttcggcatgcaactgcactggctgggttatgccggctatcgtgagcggcatgctgcgggcttctggtcgccgtggcaggcccgctatcccggtctttatccgattgccgaaggcggtggcgggcttgccggtgcattgggttgcggtcggttgcgggcaatgctcgacgcgcagctcgggcacctgggctgggacgattaccacggatggtggttggcggcaggcaccggcaccacgctggccggcttgctgttggcagaggcgggcgcccggccggtgtatggggcgatggctgtgcccgaggatcacggggtcgcgcaaaacatcatcgcggtgctgaatgaggcggccggtgcgcaaaccgatgtcgcgccgcgcctgccacccacttgtattctgctcgatgccagccgcggcggtttcgccagaaccgacgcggcgctgctcggtttcattgccgacagcgaggcacagagcggtgtacctctggagccgctgtacaccggcaaggcgttgctggccctgcatgatgaagtgctggccggtcgtttcgcgcccggcacccggctggtcttcgtccacaccggcggccttcaggggcggcgtgcgatgggcctgtaa

SEQ ID NO: 105 - protein, 314 aa, Pseudomonas syringae
  Pseudomonas syringae pv. syringae B728a
MMLDALGWQPTAPLERLNLPWLQDTGVEVAILRLDLIDALISGNKWFKLSEHLSLAVDSGAEGLISLGGAHSNHLHALAAAGKRFGFPTVGLLRGHTQQTPTVLDLQAFGMQLHWLGYAGYRERHAAGFWSPWQARYPGLYPIAEGGGGLAGALGCGRLRAMLDAQLGHLGWDDYHGWWLAAGTGTTLAGLLLAEAGARPVYGAMAVPEDHGVAQNIIAVLNEAAGAQTDVAPRLPPTCILLDASRGGFARTDAALLGFIADSEAQSGVPLEPLYTGKALLALHDEVLAGRFAPGTRLVFVHTGGLQGRRAMGL

SEQ ID NO: 106 - DNA, 1017 bp, Pseudomonas syringae
  Pseudomonas syringae pv. syringae B728a
  CDS (1)..(1017): transl_table=11
atgaacctgagcaagttcaagcgctaccctctgaccttcggcccctcgcccattaccccactaaaacgcctgagtgagcacctgggcggcaaggtcgagttgtatgccaagcgcgaggattgcaacagcggtctggccttcggcggcaacaagacccgcaaactggaatacctggtgccggaagccatcgacggcggctacgacacgctggtatcgatcggtggcatccagtccaaccagacccgtcaggtggcagccgtggcggcgcatctgggcatgaagtgcgtgctggttcaggagaattgggtcaactattccgacgcgttgtacgaccgggtcggcaatatcgagatgtcgcgcatcatgggcgccgatgtgcgcctggattcggcaggcttcgatatcggcattcgcccgagctgggaaaaggccatggccgacgtcgaggaaagcggcggcaagccgttcccgattcctgcgggctgctcggaacacccttatggcggcctggggttcgtgcgttttgccgatgaagtgcgccagcaggaagaagagctgggcttcaaattcgactacattgtggtctgctcggtgaccggcagcactcacgcaggcatgctggtgggcttcgctgccgatggccgggcacaacgtgtgatcggtatcgacgcgtcggcgaaaccggaaaagacccgcgcgcaggtcctgcgcatcgctcagaacactgcaaaactggtggagctgggccgcgaaataaccgccgaagacgtggtgctcgacacccgctacgcctacccggaatacggcctgccgaacgatggcaccctcgaagccatccgcctctgcgcccgcctggaaggcgtgctgaccgacccggtctacgaaggcaaatccatgcacggcatgatcgacatggtgcgcaatggcgaattccccgaaggctcgaaagtgctctacgcccacctgggcggcgtgccggcgctgaatgcctacagctttctgttcaaggacggttga

SEQ ID NO: 107 - protein, 338 aa, Pseudomonas syringae
  Pseudomonas syringae pv. syringae B728a
MNLSKFKRYPLTFGPSPITPLKRLSEHLGGKVELYAKREDCNSGLAFGGNKTRKLEYLVPEAIDGGYDTLVSIGGIQSNQTRQVAAVAAHLGMKCVLVQENWVNYSDALYDRVGNIEMSRIMGADVRLDSAGFDIGIRPSWEKAMADVEESGGKPFPIPAGCSEHPYGGLGFVRFADEVRQQEEELGFKFDYIVVCSVTGSTHAGMLVGFAADGRAQRVIGIDASAKPEKTRAQVLRIAQNTAKLVELGREITAEDVVLDTRYAYPEYGLPNDGTLEAIRLCARLEGVLTDPVYEGKSMHGMIDMVRNGEFPEGSKVLYAHLGGVPALNAYSFLFKDG

SEQ ID NO: 108 - DNA, 996 bp, Pseudomonas fluorescens
  Pseudomonas fluorescens Pf-5
  CDS (1)..(996): transl_table=11
atgatcaaacaacagctcgcccgctttaaccgtctcgacctgctcaggtctaccaccgccctggaaaaactcgaacgcctgtcggcctggatcggtcgcgatgtctacgtcaagcgtgacgacagcacacccctggccatgggcggcaacaagctgcgcaagctcgaatacctggccgccgatgccctggcccagggcgccgacaccctgatcaccgccggtgccatccagtccaaccatgtgcgccagaccgcagccctggctgccaagttggggctgggctgcgtggccctgctggaaaaccccaccggcacccaagaccccaactacctgggcaatggcaaccgcctgctgctggacctgttcgacgccaaggtggagctggtggaaaacctcgaccaggccgacgagcaactgcacgccctggccgcgcgcctgcgcagcaacggcaagaaaccctacctggtgcccatcggcggctccaacgccctgggggccctgggctacgtgcgcgccggcctggagctggcgcagcagatcgaagacagcggcctggaatttgccgccgtggtcctggcctccggcagcgccggcacccacagcggcctggccctggccttgagcgaagtgctgccgcaactgccggtgatcggggtcaccgtgtcgcgcagcgaagaagaccagcggcccaaggtccagggcctggccgaacgcaccgccgagttgctgggagtgaagctgcccgacgctttcaacgtgcagttgtgggacgagtacttcgccccgcgctacggtgagcccaatgccgggacgctggcggcggtcaagctgctggccagccaggaaggcctgttgctggacccggtgtacaccggcaaggccatggccggcctgctggacggggtcggtcgccagcgcttcgacgatggcccgctgattttcctgcacaccggcggcgccccggccctgttcgcctacgccggcgccttctcgtag

SEQ ID NO: 109 - protein, 331 aa, Pseudomonas fluorescens
  Pseudomonas fluorescens Pf-5
MIKQQLARFNRLDLLRSTTALEKLERLSAWIGRDVYVKRDDSTPLAMGGNKLRKLEYLAADALAQGADTLITAGAIQSNHVRQTAALAAKLGLGCVALLENPTGTQDPNYLGNGNRLLLDLFDAKVELVENLDQADEQLHALAARLRSNGKKPYLVPIGGSNALGALGYVRAGLELAQQIEDSGLEFAAVVLASGSAGTHSGLALALSEVLPQLPVIGVTVSRSEEDQRPKVQGLAERTAELLGVKLPDAFNVQLWDEYFAPRYGEPNAGTLAAVKLLASQEGLLLDPVYTGKAMAGLLDGVGRQRFDDGPLIFLHTGGAPALFAYAGAFS

SEQ ID NO: 110 - DNA, 1023 bp, Psychrobacter arcticus 273-4
  Psychrobacter arcticus 273-4
  CDS (1)..(1023): transl_table=11
atgcaaaataaatctataccaagcctgccgagcatgaatcgacaacctttaggatttttcccaacgccgttgattgagctgaccagattaagcaaagcacttaatggccctaaaatttatatgaaacgagatgacaatacgggactggcattaggcggtaataaaaccagaaagcttgagtttattattggggatgcacttgctcaaggtgcggatacgatcgtgacagcaggtgctgcgcagtcaaatcattgtcgccagaccgcagccgccgcagccagtttgggacttgaatgccatttagttttgggcggacaagagccggatcagctcaatggcaatcttttactggataagatttttggctgtcatattcactgggcaggcaataatcgtaaaggagaagacattcctgatattgtagagcagctcgaaaatgcaggtaagaaaccctatgttgtcccttatgggggctcaagcgagctgggggcttttgcctttatcgaagctttcaaagagcttgaatcgcaacgtcaagagatggatatctcgttcactcatatcgtttttgcgtctagctccggtgggacacaagcgggcttaatgcttggcaataaaatctttaactcaccttatcaaatagtgggcatcaatattgataaaggtgaaacggataaagtaccttttgatcagtatattgtctcccttgccaacagcacagcagcattgatcggtgcagactatagcttttcagagacagatctaatgcttaattctgattatgtgggagacggttatggggttattggcgcattagaaaatgaagccattgccatgaccgcgcaaacggaaggcatattattagatcctgtttatacgggtcgtgcgatgggcgggctcatagatatgattcgtaccggtaaaatcaagaaaacggacagtgtgttattttggcatactggcggcgcgcccgctttgttcgcttatgccagtgctttagcggtgtctcaaagcgatagttag

SEQ ID NO: 111 - protein, 340 aa, Psychrobacter arcticus
  Psychrobacter arcticus 273-4
MQNKSIPSLPSMNRQPLGFFPTPLIELTRLSKALNGPKIYMKRDDNTGLALGGNKTRKLEFIIGDALAQGADTIVTAGAAQSNHCRQTAAAAASLGLECHLVLGGQEPDQLNGNLLLDKIFGCHIHWAGNNRKGEDIPDIVEQLENAGKKPYVVPYGGSSELGAFAFIEAFKELESQRQEMDISFTHIVFASSSGGTQAGLMLGNKIFNSPYQIVGINIDKGETDKVPFDQYIVSLANSTAALIGADYSFSETDLMLNSDYVGDGYGVIGALENEAIAMTAQTEGILLDPVYTGRAMGGLIDMIRTGKIKKTDSVLFWHTGGAPALFAYASALAVSQSDS

SEQ ID NO: 112 - DNA, 960 bp, Colwellia psychrerythraea
  Colwellia psychrerythraea 34H
  CDS (1)..(960): transl_table=11
atgcataagccattgtccaaaatacaaaaattagaacaccctctctttgataaatacaacctagatgttcgcgtcaagcgtgatgatttactgcataacatcatatcaggcaataaatggcgcaaactaaagcacaacctagagcaacttaaaactaatgattaccaaggagcattaacttttggtggtagttactcaaaccatattcatgcttttgcttacgcatgtaaacagcataacatcccctgcatcggtgttattagaggggaagctaactatgcgaataactttacattgagttgggcgcggcactggggcatgcaatgtcactttgtcgacagaaagacctatcgtcgccgttttgagacaaactttattgatgaactaaaaacactatatcctaattactttgttattcctgaaggtggcagtaattcacttgctataccaggcgttgccgaggtgttgactgaattgaatagccaagtagatttcgataccttaatcaccccagtaggtagcggaggtacgttagcaggtttaatttcgggagatagtgtcgccaatcagaaacaacataaaattttgggtattgctgtattaaaacaagcggaatatttagttgatgacattaagcgcttgcttactgaagaagctaagaaccatgagaactggaagttattaaccaactttcatcgtggtggttatggcaagtttagtgaggatgatgtcaaacgaataataacattcaaccagcaaaccggcgtatgctttgaaccggtatattcaggtaaaatggtattagctttacttgatttaataacgcaaggctattttcagccgcaagaacgcattgttttattgcacactggtggattacaaggactgggcggcatgatagaacaaggtaggttagatgccaatgactggccaccattaagcagcgttgacaatgaataa

SEQ ID NO: 113 - protein, 319 aa, Colwellia psychrerythraea
  Colwellia psychrerythraea 34H
MHKPLSKIQKLEHPLFDKYNLDVRVKRDDLLHNIISGNKWRKLKHNLEQLKTNDYQGALTFGGSYSNHIHAFAYACKQHNIPCIGVIRGEANYANNFTLSWARHWGMQCHFVDRKTYRRRFETNFIDELKTLYPNYFVIPEGGSNSLAIPGVAEVLTELNSQVDFDTLITPVGSGGTLAGLISGDSVANQKQHKILGIAVLKQAEYLVDDIKRLLTEEAKNHENWKLLTNFHRGGYGKFSEDDVKRIITFNQQTGVCFEPVYSGKMVLALLDLITQGYFQPQERIVLLHTGGLQGLGGMIEQGRLDANDWPPLSSVDNE

SEQ ID NO: 114 - DNA, 999 bp, Pseudomonas syringae
  Pseudomonas syringae pv. phaseolicola 1448A
  CDS (1)..(999): transl_table=11
atgatcaaaaatcagcttgcccgtttcaatcgcctggacttgatcagcgcgccgacggctctggaaaagcttgagcgcctgtcgatctgggcagatcgcgatatctacatcaagcgtgatgacaccaccaccctggcgctgggcggcaacaaggttcgcaaacttgaatacctcgccgcagacgcgctggcccaaggtgccgacacgctgatcactgcgggcgctatccagtccaaccatgttcgccagactgctgccctggcggcgcgcctgggctttggctgcgtggcgctgctggaaaaccccatcggcactgaagacccgagttacctgaaaaacggcaatcgcctgctgctggagctgttcgatgccaaggtcgagctggtcgaaaacctcgacaacgccgacgaacaactgcacgcgctggctgcgcgtctgcgctccagcggcaagaagccttatctggtacccatcggtggctcaagcccggtcggtgcgctgggttatgttcgcgccgggctggaactggctgagcagatcaagcagaccggcatcgactttgcggcggttgttctggcctccggcagcgcgggcacccacagcggcctggcgttggcactggctcacgagttgccgcaattgccggttatcggcgtgaccgtttcgcgcagtgaagaagcacaactgcccaaagtgcagggcttggccgagcgtacggcagaattactggatatcgccctgccggagcacttcaaggttgaactgtgggacgaatatttcgctccgcgttatggcgaaccgaacgccggtacgctggcggcgatcaagctggtggccagccacgaagggctgttgctggacccggtttataccggcaaggccatgtccggcttgctggatggcattggccgtcaacgcttcaacgacggcccgctgatctttctgcacactggcggtgctccggcgctgtttgcctacccggatgcgtttgatcagtaa

SEQ ID NO: 115 - protein, 332 aa, Pseudomonas syringae
  Pseudomonas syringae pv. phaseolicola 1448A
MIKNQLARFNRLDLISAPTALEKLERLSIWADRDIYIKRDDTTTLALGGNKVRKLEYLAADALAQGADTLITAGAIQSNHVRQTAALAARLGFGCVALLENPIGTEDPSYLKNGNRLLLELFDAKVELVENLDNADEQLHALAARLRSSGKKPYLVPIGGSSPVGALGYVRAGLELAEQIKQTGIDFAAVVLASGSAGTHSGLALALAHELPQLPVIGVTVSRSEEAQLPKVQGLAERTAELLDIALPEHFKVELWDEYFAPRYGEPNAGTLAAIKLVASHEGLLLDPVYTGKAMSGLLDGIGRQRFNDGPLIFLHTGGAPALFAYPDAFDQ

SEQ ID NO: 116 - DNA, 945 bp, Pseudomonas syringae
  Pseudomonas syringae pv. phaseolicola 1448A
  CDS (1)..(945): transl_table=11
atgatcgttgacgcccttgactggcagcccactgctgcgctgcaacgcttgaacctgccctggctgcaagatgccggggtcgaggtggcgatcctgcgtcttgaccttattgactcgctcatcagcggcaacaaatggttcaagctcagcgaacacctgacccaggctgtagaggcgggtgcagagggattgatcagcctgggcggcgcatactccaatcatctccatgctctggcagcagcgggcaggcgcttcggtttcccgacggtgggcctgttgcgtggtcacgcccagcagacgccgacggtactggacctgcaagcttttggcatgcaattgcattggttgggttatgcgggttatcgagcacgacatgctgcggatttctggctgccctggcaggcgcaatatcctgagctgtatccgattgccgaaggcggtggcgggcttgccggtgcgctgggctgcgcaaggttgcgggagatggtcgatagccagctcgggcaccttggctgggacgattatcacggctggtggctggcagtcggcaccggcacaacgcttgccggtttgctgttggccgaggccggcgcccatccggtatatggcgcgatggcggtgccggacgatcatggcgttgctcaaaacatcgtggctgtgttgaaagaagccgcagggtcgcaggtgaacgcctcgccgaacctgcccgctgcctgtgtcctgctggaggccagccggggcggtttcgccaggaccgatgccgcgctgctcgacttcatcgccagcagcgaggcgcataccggcgtacctctggagcccttgtacaccggcaaggctttgctggccctgcacgatgaggtgctggccggtcggttcaagtcaggcagccgtctggtcttcgtccataccggtggcctgcaggggcggcgcgcgatgggcctgtaa

SEQ ID NO: 117 - protein, 314 aa, Pseudomonas syringae
  Pseudomonas syringae pv. phaseolicola 1448A
MIVDALDWQPTAALQRLNLPWLQDAGVEVAILRLDLIDSLISGNKWFKLSEHLTQAVEAGAEGLISLGGAYSNHLHALAAAGRRFGFPTVGLLRGHAQQTPTVLDLQAFGMQLHWLGYAGYRARHAADFWLPWQAQYPELYPIAEGGGGLAGALGCARLREMVDSQLGHLGWDDYHGWWLAVGTGTTLAGLLLAEAGAHPVYGAMAVPDDHGVAQNIVAVLKEAAGSQVNASPNLPAACVLLEASRGGFARTDAALLDFIASSEAHTGVPLEPLYTGKALLALHDEVLAGRFKSGSRLVFVHTGGLQGRRAMGL

SEQ ID NO: 118 - DNA, 1017 bp, Pseudomonas syringae
  Pseudomonas syringae pv. phaseolicola 1448A
  CDS (1)..(1017): transl_table=11
atgaacctgagcaagttcaagcgctaccctctgaccttcggcccctcgcccatcacccctctgaaacgcttgagcgagcatctgggtggcaaggtcgagttgtatgccaagcgcgaggattgcaacagcggtctggcttttggcggtaacaagacccgcaaactggaatacctggtgccggaagccatcgacggcggctacgacacactggtgtcgatcggcggcatccagtccaaccagacccgtcaggtggcagcagtcgcggcgcatctgggtatgaaatgcgtgctggttcaggaaaactgggtcaactattcagacgccctgtacgaccgagtgggcaatatcgagatgtcacgcatcatgggggccgatgtgcgcctggactcggcaggcttcgatatcggcattcggccgagctgggaaaaggccatgtccgacgtcgaggaaagcggtggcaagccgttcccgattcctgcgggctgctcggaacacccttatggcggcctgggattcgtgcgttttgccgatgaggtacgccagcaggaagaagaactcggcttcaaattcgactacatcgtggtctgctcggtgaccggcagcactcacgcaggcatgctcgtcggcttcgcggccgatggccgggcacagcgtgtgatcggtatcgatgcgtcggccaaaccggaaaagacccgcgcacaagtcctgcgcatcgctcagaacaccgcaaaactggtggaactgggccgcgaaatcaccgccgaagacgtggtgctcgacacccgctacgcctaccccgaatacggcctgccgaacgagggcacccttgaagccattcgcctttgcgcgcgccttgaaggcgtattgaccgacccggtctacgaaggcaaatccatgcacggcatgatcgacatggtgcgcaatggtgaattccccgagggctcaaaagtgctctacgcacatttgggcggcgtaccggcgttgaatgcctacagttttctgttcaaggacggttaa

SEQ ID NO: 119 - protein, 338 aa, Pseudomonas syringae
  Pseudomonas syringae pv. phaseolicola 1448A
MNLSKFKRYPLTFGPSPITPLKRLSEHLGGKVELYAKREDCNSGLAFGGNKTRKLEYLVPEAIDGGYDTLVSIGGIQSNQTRQVAAVAAHLGMKCVLVQENWVNYSDALYDRVGNIEMSRIMGADVRLDSAGFDIGIRPSWEKAMSDVEESGGKPFPIPAGCSEHPYGGLGFVRFADEVRQQEEELGFKFDYIVVCSVTGSTHAGMLVGFAADGRAQRVIGIDASAKPEKTRAQVLRIAQNTAKLVELGREITAEDVVLDTRYAYPEYGLPNEGTLEAIRLCARLEGVLTDPVYEGKSMHGMIDMVRNGEFPEGSKVLYAHLGGVPALNAYSFLFKDG

SEQ ID NO: 120 - DNA, 1017 bp, Ralstonia eutropha
  Ralstonia eutropha JMP134
  CDS (1)..(1017): transl_table=11
atgaaaaaaatctcggatcgcattgcttcattttcccgccttcaactggtcggcgcggtcacccccctggagaaactcgatcgcttgtctcgtatgctcggtcgcgatgtctacatcaagcgcgatgacaccacgccactcgcctttggcggaaacaagctgcgcaagctcgagtttctggcggccgacgccttgagcaaaggtgctgatacgctggtgacagccggcgcgattcagtcgaatcatgtccggcaaacggccgccgtggcagcccgtcttggactgcgttgccacgcgttgctggagaacccaatcaacaccacggacgtcgactatctgcgcagcggtaatcgcctgctgctcgacctgttcgacgcgcacggtgaaccggttgccacgctcgacaatgccgacgcccagttgcaagcactggccgaacgactgcgcggcgacgggtatcagccctacatcatcccaatcggcgggtccaatccgcttggcgcattgggatatgtccatgccggcctggagatggcgcagcaagccgacgcgatgggcgtttcatttgcggctgtcgtgctggcatccggcagtgcgggaacccacggaggcctggcgttggcactcgcccatgcaatgccggacgcacaagtcgtcggtattaccgtgtcccggcccgtcgaggcgcaggcgcccaaggtggcagggctgatcgacggaacggcggaattgctcgacatcgaagtaccggcggaactgcggctcgaactgtgggacgaatatttcctgccccgctatggcgaacctaaccgggctgcgctcgatgccatcagattgctggcccgtacggagggagtcctcctcgaccccgtgtatacgggaaaagcgatggctggcctgctcgacggcgtgatgcgcaagcgctttgcgggtgagggtccgctgctgttcctgcataccggcggcgcaccggcgctatttgcctatcgcgacgcgctcccggcagtcctcatttaa

SEQ ID NO: 121 - protein, 338 aa, Ralstonia eutropha
  Ralstonia eutropha JMP134
MKKISDRIASFSRLQLVGAVTPLEKLDRLSRMLGRDVYIKRDDTTPLAFGGNKLRKLEFLAADALSKGADTLVTAGAIQSNHVRQTAAVAARLGLRCHALLENPINTTDVDYLRSGNRLLLDLFDAHGEPVATLDNADAQLQALAERLRGDGYQPYIIPIGGSNPLGALGYVHAGLEMAQQADAMGVSFAAVVLASGSAGTHGGLALALAHAMPDAQVVGITVSRPVEAQAPKVAGLIDGTAELLDIEVPAELRLELWDEYFLPRYGEPNRAALDAIRLLARTEGVLLDPVYTGKAMAGLLDGVMRKRFAGEGPLLFLHTGGAPALFAYRDALPAVLI

SEQ ID NO: 122 - DNA, 987 bp, Staphylococcus saprophyticus
  Staphylococcus saprophyticus subsp. saprophyticus ATCC 15305
  CDS (1)..(987): transl_table=11
atgttacataataaattagatattgccaatttaaatacaccaattcaaaaattagatcagttaagtgatgcattaggaaaaaatatttatattaagagagatgattacactggatcagaaatatcaggtaataaggtgcgtaaactcgagtatacaatgcaatatgtattagatcatggatatgacactattataacaaccggggcaattacatcgaatcacgcacgtgctacagctgccttgtgtgctaagtgtaatgtatcatatcttgttctaagaggagagatggcagaatatgaagggaatctatttttagatgcaatgttaggtgcgcatatacatatcatcgaaccaacaagttctcgggaagatgcgatggataagctatataagacatttgaaggacaagggaaaactccatttttaattccagtgggtgcttcggattggataggaacacatggttacgttaatgcgtataatgaaatcataaagcaacaggatgagctgaaagtacattttgattcaatcaatgttgctgttggttctggtggtacgtatgctggtctttggtatgggcaaatgattaactgtgaaactacgcaaattataggttatgcagtagaccaaagtgcacatacattcaaaaataaagtgatagagataataaagcaattagatgaaacaattcaatcatacgagacaattacgataaacgatgcttatattggactgggatatggtaaagcaactgacgaagaattacaattttatatcgatattgcacaaaaagaaggcattatactagatccaacatatactggaaaagcttttagaggtttagttcatgaaataaaatctggtgcgtatgataatcaagacaacattctatttatacatacgggtggactacaaggctatactcaagagacacgtttacgtttgcaaacgatgttgcataaaatagatctttcattattaaagtaa

SEQ ID NO: 123 - protein, 328 aa, Staphylococcus saprophyticus
  Staphylococcus saprophyticus subsp. saprophyticus ATCC 15305
MLHNKLDIANLNTPIQKLDQLSDALGKNIYIKRDDYTGSEISGNKVRKLEYTMQYVLDHGYDTIITTGAITSNHARATAALCAKCNVSYLVLRGEMAEYEGNLFLDAMLGAHIHIIEPTSSREDAMDKLYKTFEGQGKTPFLIPVGASDWIGTHGYVNAYNEIIKQQDELKVHFDSINVAVGSGGTYAGLWYGQMINCETTQIIGYAVDQSAHTFKNKVIEIIKQLDETIQSYETITINDAYIGLGYGKATDEELQFYIDIAQKEGIILDPTYTGKAFRGLVHEIKSGAYDNQDNILFIHTGGLQGYTQETRLRLQTMLHKIDLSLLK

SEQ ID NO: 124 - DNA, 987 bp, Shigella sonnei
  Shigella sonnei Ss046
  CDS (1)..(987): transl_table=11
atgccactgcataatttaacccgttttccacggttggagtttatcggcgcgccaacgccgctcgaatatctgccgcgcttttctgattatctaggacgggaaattttcatcaaacgggatgacgtcacccccatggcaatgggcggcaataaattacgtaagctagaatttctcgcggcagatgctctgcgcgaaggtgccgatacgctgattactgccggggtgatccagtctaaccatgtgcggcagactgccgcagttgcggcgaaactcggtctgcactgtgtggcgctgctggaaaatcctattggcacaaccgcagaaaactatttaaccaacggcaatcgcttgttgctggatctgttcaatacccagattgaaatgtgcgaagcactgaccgatcccaatgcccaactggaagagctggcgacgcgagtcgaagcacaaggctttcgcccgtatgtcattccggttggcggttctaatgctcttggcgcgctaggttatgtggagagtgcgctggaaatcgcgcaacagtgtgaaggggcggttaatatttcgtcggtggtagtcgcatcgggcagtgccggaactcacgccggactggctgttgggctggaacacctgatgcctgaaagcgaactgattggcgtgaccgtgtcgcgttccgttgccgatcagttgccgaaagtggttaacctacaacaggcgattgcgaaagaactggagctgaccgcatcagcggaaattatactctgggatgactattttgcacctggctacggcgtgccgaacgacgaaggcatggaagcagtgaaattgctggcgcggctggaaggcattctgcttgatcctgtgtataccggaaaagcgatggcggggctgattggctgtatcagtcagaaacgcttcaaagatgaagggccgattctgtttattcataccggcggtgcgcctgcgctgttcgcctatcatccccacgtttag

SEQ ID NO: 125 - protein, 328 aa, Shigella sonnei
  Shigella sonnei Ss046
MPLHNLTRFPRLEFIGAPTPLEYLPRFSDYLGREIFIKRDDVTPMAMGGNKLRKLEFLAADALREGADTLITAGVIQSNHVRQTAAVAAKLGLHCVALLENPIGTTAENYLTNGNRLLLDLFNTQIEMCEALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEIILWDDYFAPGYGVPNDEGMEAVKLLARLEGILLDPVYTGKAMAGLIGCISQKRFKDEGPILFIHTGGAPALFAYHPHV

SEQ ID NO: 126 - DNA, 924 bp, Anabaena variabilis
  Anabaena variabilis ATCC 29413
  CDS (1)..(924): transl_table=11
atgtcattgacctttgttcctcccccaatacaaaaaatcaatagtgagattgctaataacgctggtgtagaaattgatgtattacgccttgatttaatgcacccgtgggtaaacggtaataagtggtacaagctaaaatacaatctcttagaagcgaaagagaaaggttatacaacattacttacctttggtggtgcatattctaatcacatctttgctacagccgccgcaggtaatctgttaggtttccagactattggtgtgattcgcggggaggaaaccttacccttaaatcccacactaagttttgccacaaaacaaggtatgcagcttgtctatgtggacagggaaacctatcgacaacgaaacagcgccacattacacgcagacttaaggaaacgcttcggtgaggtatttatcattcctgaaggtggtagtaatttgaatggtgtgcgcggttgtctagaaatcatcagtgccgcaacgcaagcatttaatattgtgtgtgtagcttgtggtacagccactactctagcaggtatcgctctggcgctggaagcaaagcaacgtgtcatcggttttcctgtgttaaaaaatgggggttttctagcagaggaaattactcagtttatgaataattatgtcgcggcggggctgcccatttcatcaagttctcccgcgcattgggaattagtttgcgattaccattttggcggttacgccaaggtgaaagatgatcttatcgtgttcagtcagcagtttacccaaacccacggcgtaccccttgattacgtgtataccgcgaaaatgttttatggtgtgatggacttgttaaagcaaagatattttacaaaaggcgatcgcatcttgatgattcacaccggtggcttacaaggaaatatcgggatgagtgaacgattgtaa

SEQ ID NO: 127 - protein, 307 aa, Anabaena variabilis
  Anabaena variabilis ATCC 29413
MSLTFVPPPIQKINSEIANNAGVEIDVLRLDLMHPWVNGNKWYKLKYNLLEAKEKGYTTLLTFGGAYSNHIFATAAAGNLLGFQTIGVIRGEETLPLNPTLSFATKQGMQLVYVDRETYRQRNSATLHADLRKRFGEVFIIPEGGSNLNGVRGCLEIISAATQAFNIVCVACGTATTLAGIALALEAKQRVIGFPVLKNGGFLAEEITQFMNNYVAAGLPISSSSPAHWELVCDYHFGGYAKVKDDLIVFSQQFTQTHGVPLDYVYTAKMFYGVMDLLKQRYFTKGDRILMIHTGGLQGNIGMSERL

SEQ ID NO: 128 - DNA, 1017 bp, Burkholderia pseudomallei
  Burkholderia pseudomallei 1710b
  CDS (1)..(1017): transl_table=11
atgaatctccagaaatttccgcgttatccgctgaccttcggcccgacgccgatccagccgctcaagcggctttccgcgcatctcggcggcaaggtcgagctgtacgcgaagcgcgacgactgcaacagcggcctcgcgttcggcggcaacaagacgcgcaagctcgaatacctgatcccggacgcgctcgcgcaaggctgcgacacgctcgtatcgatcggcggcatccagtcgaaccagacgcgccaggtcgcggcggtggccgcgcatctcggcatgaagtgcgtgctcgtgcaggagaactgggtcaactatcacgacgccgtctacgatcgcgtcggcaacatccagatgtcgcgcatgatgggcgccgacgtgcgcctcgtgccggacggcttcgacatcggctttcgcaagagctgggaggatgcgctcgccgatgtccgcgcgaggggcggcaagccgtatgcgattccggccggctgctccgaccatccgctcggcggcctcggcttcgtcggctttgccgaggaagtgcgcgcgcaggaggccgagctcggtttccaattcgattacgtcgtggtgtgctcggtgacgggcagcacgcaggccgggatggtcgtcggcttcgcggcggacgggcgcgcggaccgcgtgatcggcgtcgacgcgtcggcgaagcccgcgcagacgcgcgagcagatccttcggatcgcgaagcataccgccgatcgcgtcgagctgggccgcgacatcacgagcgccgacgtcgtgctcgacgagcgcttcggcggccccgagtacgggctgccgaacgagggcacgctcgaggcgatccggctgtgcgcgaagctcgaaggcgtgctgaccgatcccgtctacgaaggcaagtcgatgcacgggatgatcgagaaggtgcggctcggcgaattcccggccggctcgaaggtgctgtacgcgcatctcggcggcgtgcccgcgctgaacgcgtacagctttttgttccgcgacggctga

SEQ ID NO: 129 - protein, 338 aa, Burkholderia pseudomallei
  Burkholderia pseudomallei 1710b
MNLQKFPRYPLTFGPTPIQPLKRLSAHLGGKVELYAKRDDCNSGLAFGGNKTRKLEYLIPDALAQGCDTLVSIGGIQSNQTRQVAAVAAHLGMKCVLVQENWVNYHDAVYDRVGNIQMSRMMGADVRLVPDGFDIGFRKSWEDALADVRARGGKPYAIPAGCSDHPLGGLGFVGFAEEVRAQEAELGFQFDYVVVCSVTGSTQAGMVVGFAADGRADRVIGVDASAKPAQTREQILRIAKHTADRVELGRDITSADVVLDERFGGPEYGLPNEGTLEAIRLCAKLEGVLTDPVYEGKSMHGMIEKVRLGEFPAGSKVLYAHLGGVPALNAYSFLFRDG

SEQ ID NO: 130 - DNA, 909 bp, Pseudoalteromonas haloplanktis
  Pseudoalteromonas haloplanktis TAC125
  CDS (1)..(909): transl_table=11
atgttaaataaacttaaaataaatgaaaacaaccaaatacaacaaatagatagtgatttattaaagcgcaaaaatatatttttaggcgttaagcgcgatgatctactccaccccctcataagtggaaataaatggcgaaagcttaaatacaatttagcccagatgcaggcgcttaaaaaaactgaattactcacttttggtggggctttttctaatcatattcatgcgtgtgcggcggctggcaagttttttaatataaaaacgcacgggattattcgcggcccagaactagaccctaacaatcctacacttttgttcgcacagcaatgtggtatgcagctacacccaatcacacgtatagagtacaaacaacgtagccaaagcgattatttaacgcagttgcaatcgcgtttccctaatgcctatattttacctgaaggtgggacaaataaactggcgcttgagggttgtaaagagcttgccctgagcttacctaagcacgactacttagtttgccccacaggaagcggtggcaccttagcgggacttattgaaggcagttcagttaatacaacggtactgggaattgcggtactaaaacaagctgactatttacgcgatgaaattaaagcgcttagccctaaagccgcttcacaaactaattggcaattattatgtgattttcatggtggtggttatggtaagttttctgccgaactttggcagttttgccaatacatgaaaactgagcaccaactgccattagagcctatttatactggtaaaatgatgcatgctttgtggcaattaattgcgcaggactactttgcgccaggcagtaaaattattgcggttcatacgggtgggttacaaggattagatggtttaaaatacagaggacttatttaa

SEQ ID NO: 131 - protein, 302 aa, Pseudoalteromonas haloplanktis
  Pseudoalteromonas haloplanktis TAC125
MLNKLKINENNQIQQIDSDLLKRKNIFLGVKRDDLLHPLISGNKWRKLKYNLAQMQALKKTELLTFGGAFSNHIHACAAAGKFFNIKTHGIIRGPELDPNNPTLLFAQQCGMQLHPITRIEYKQRSQSDYLTQLQSRFPNAYILPEGGTNKLALEGCKELALSLPKHDYLVCPTGSGGTLAGLIEGSSVNTTVLGIAVLKQADYLRDEIKALSPKAASQTNWQLLCDFHGGGYGKFSAELWQFCQYMKTEHQLPLEPIYTGKMMHALWQLIAQDYFAPGSKIIAVHTGGLQGLDGLKYRGLI

SEQ ID NO: 132 - DNA, 1005 bp, Pseudomonas fluorescens
  Pseudomonas fluorescens PfO-1
  CDS (1)..(1005): transl_table=11
atgtccacacaaccgatcaaacaacagctgcaacgcttcaaccgcctcgacctgctcggccaaccgaccccactggaaaagctcgagcgtctgtccacctggctcggccgcgatgtctacatcaaacgcgatgacctgacgcctttggccatgggcggcaacaagctgcgcaagctcgaatacctcgccgccgatgccatcgcccaaggcgcggataccctgatcaccgccggtgcactgcaatcgaaccacgttcgccagactgccgcgctggccgccaaactgggcctgggttgcgtagcgctgctggaaaacccgctgggcaccgacgacagcaactacaccggcaacggcaaccgcctgctgctggacctgttcgacaccaaggtcgagctggtcgacaacctcgacaacgccgacgaacaactggccgccctcgccgtgcgcctgcgcagcaacggcaagaagccgtatctggtgccgatcggtggctccaacgccatcggtgcgctgggttatgtgcgcgccggtctggagctggcagaacagatcaaggacaccggcctgcaattctccgccgtcgttttggcctctggcagcgccggtactcacagcggtctggcgctggccctgagcgaagccctgccacaactgccggtgattggcgtgacggtgtcgcgcagcgaagaagatcagcgcccgaaagtccagggcctcgccgaacgcaccgccgacctgctgggtgtggcgctgccggacagcttcaaggtcgagttgtgggacgaatacttcggcccgcgctatggtgagccgaatgccgggacgctgtcggcggtgaagctgctggccagccaggacgccgtgttgctcgatccggtctacaccggcaaggccatggccggactgctcgacggcatcggtcgcgggcgtttcgacgacggcccgatcatcttcctgcacaccggcggcgccccggcgttgtttgcgtacaaggattttctctga

SEQ ID NO: 133 - protein, 334 aa, Pseudomonas fluorescens
  Pseudomonas fluorescens PfO-1
MSTQPIKQQLQRFNRLDLLGQPTPLEKLERLSTWLGRDVYIKRDDLTPLAMGGNKLRKLEYLAADAIAQGADTLITAGALQSNHVRQTAALAAKLGLGCVALLENPLGTDDSNYTGNGNRLLLDLFDTKVELVDNLDNADEQLAALAVRLRSNGKKPYLVPIGGSNAIGALGYVRAGLELAEQIKDTGLQFSAVVLASGSAGTHSGLALALSEALPQLPVIGVTVSRSEEDQRPKVQGLAERTADLLGVALPDSFKVELWDEYFGPRYGEPNAGTLSAVKLLASQDAVLLDPVYTGKAMAGLLDGIGRGRFDDGPIIFLHTGGAPALFAYKDFL

SEQ ID NO: 134 - DNA, 1080 bp, Burkholderia sp.
  Burkholderia sp. 383
  CDS (1)..(1080): transl_table=11
atgactttcaacgcgccaacctctctcgcgtaccctgcgcgagcgaacctccagggattgttcggcttcgattcaatccgggtgccgcgttaccgtctgctcgatggcgcaacgccgattcatcccctgccgcgcctgagtgcctatcttggcggggcgaccattcatgtcaagcgggaggacgtagcgagcgtgggcggcggcggcaacaaattgcggaaactggagctcctgattggcgaggcattacagtcaggcgccgacacggtcatcacggttggcgcgaggcaatcgaatcacgcacggctgaccgcggctgccgcagcccacgcggggatgcgatgcgaggttgtgctcacacgctccgtgccgcgcgacgacgccgattacatcgaaagcggcaacgtcctgctcgataacctgttcaacgctcgtgtgcacgatttgccggcttcggccgacgcgatggcatacgccatcgcacgtgcagacgaactgcgtgctgcaggccaccgtgtctatgtctgcccgttcggcggatcaagcccggttggctgcctcgcctatgctgcgtgcgcagccgaaatcgtccagcagtctcaggcgctaggcactcgcttcgatcgcatcatcgtgcccaacggaagtggcggcacacatgccgggctggttgccggcttcgcggcactcgggaccgggacggtcgaagtcgatgcctacaccgtctatgccccagccgcggacgcgtatcgcgccacgctcgacaaggcgcagcagacggccaacatcatccatcctgatacggaaatctcgcccgatgccgttcgcgtcgacgcgtcgcaactcggccccggttacggtatccccacggacgccatgcgccgcgccgtccggctgctggcctcgcaagaagggctattgctcgatccggtctatagcggaaaggcgtttgcggggctgatcgaaggcgttgcgtcaggtcgttacgcatccgaccaaagcattctcttcgtcatgaccgggggattgcctggcttattcgcgtaccggcgcgagtttcagatggctctagatggctga

SEQ ID NO: 135 - protein, 359 aa, Burkholderia
  Burkholderia sp. 383
MTFNAPTSLAYPARANLQGLFGFDSIRVPRYRLLDGATPIHPLPRLSAYLGGATIHVKREDVASVGGGGNKLRKLELLIGEALQSGADTVITVGARQSNHARLTAAAAAHAGMRCEVVLTRSVPRDDADYIESGNVLLDNLFNARVHDLPASADAMAYAIARADELRAAGHRVYVCPFGGSSPVGCLAYAACAAEIVQQSQALGTRFDRIIVPNGSGGTHAGLVAGFAALGTGTVEVDAYTVYAPAADAYRATLDKAQQTANIIHPDTEISPDAVRVDASQLGPGYGIPTDAMRRAVRLLASQEGLLLDPVYSGKAFAGLIEGVASGRYASDQSILFVMTGGLPGLFAYRREFQMALDG

SEQ ID NO: 136 - DNA, 1017 bp, Burkholderia
  Burkholderia sp. 383
  CDS (1)..(1017): transl_table=11
atgaacctgcaacgtttcccccgttatccgctcacgttcggcccgacgccgatccagccgctcaagcgcctgagcgagcacctcggcggcaaggtcgagctgtatgcgaagcgcgaggactgcaacagcggcctggcgttcggcggcaacaagacacgcaagctcgaatacctcgtccccgacgcactcgagcagggcgcggatacgctcgtgtcgatcggcggcgtgcagtcgaaccagacacgccaggtcgcggccgtcgccgcgcatctcgggatgaaatgcgtgctcgtacaggagcactgggtcaactacgaagatccggtgtacgaccgcgtcggcaacatccagctgtcgcgcatgatgggcgcggacgtgcggctcgtgtcggacggcttcgacatcggcattcgccgcagctgggaagaagcgatggagagcgtgcggcaggcaggcggcaagccttacccgattccggccggctgttctgagcatccgctcggcgggctcggattcgtcggtttcgcggaagaagtgcgggcgcaggaggcgcaactcggcttcaagttcgactacatcgtcgtgtgctcggtgacgggcagcacgcaggcggggatggtcgtcggcttcgcggccgacggccgcgccaaccgcgtgatcgggatcgatgcgtcggccacccccgagcgcacgcacgagcagatcacgcgcatcgcgcggcacacggccgagctcgtcgatctcggccggccgatcaccacggcggacgtcgtgctcgacacacgctacgccggccccgaatacgggctgccgaacgacggcacgctcgaagcgattcgcctgtgtgcgcggctcgaaggcatgctgacggatccggtgtacgaagggaagtcgatgcacgggatgatcgacaaggtacagctcggggaattcgaaccggggtcgaaggtgctgtatgcgcatctcggcggcgtgccggcgttgagtgcgtaccacgagactttccggaacggttga

SEQ ID NO: 137 - protein, 338 aa, Burkholderia sp.
  Burkholderia sp. 383
MNLQRFPRYPLTFGPTPIQPLKRLSEHLGGKVELYAKREDCNSGLAFGGNKTRKLEYLVPDALEQGADTLVSIGGVQSNQTRQVAAVAAHLGMKCVLVQEHWVNYEDPVYDRVGNIQLSRMMGADVRLVSDGFDIGIRRSWEEAMESVRQAGGKPYPIPAGCSEHPLGGLGFVGFAEEVRAQEAQLGFKFDYIVVCSVTGSTQAGMVVGFAADGRANRVIGIDASATPERTHEQITRIARHTAELVDLGRPITTADVVLDTRYAGPEYGLPNDGTLEAIRLCARLEGMLTDPVYEGKSMHGMIDKVQLGEFEPGSKVLYAHLGGVPALSAYHETFRNG

SEQ ID NO: 138 - DNA, 1002 bp, Desulfovibrio desulfuricans
  Desulfovibrio desulfuricans G20
  CDS (1)..(1002): transl_table=11
atgaatctggcaaaattcccccgccgcggctatgtgcagcaggcaactcccatcgaaaaactggataacttttccgccgcgctgggcggtaaggtgcagatttatatcaaacgtgacgacctgcttcccggttgtgccggcggcaacaagacccgcaagcttgatttctgcattgcagacgcgcttgaacagggtgctgatactatcatcacctgcggggctgtacagtccaaccactgccgtcttactcttgcctgggcggttaaagaaggcatggactgccatctggtgcttgaagagcgcgtaaagggcagctacaagccgcagggatcgggcaacaacctgcttttccaccttatgggtgtcaaaagcattactgtggttcccggcggttccgacatgatggaggcaatgaccaaggttgccggaactctgaaagaacagggcaggaacccctacattatccccggcggcgcatccaacaccataggtgccacagggtatgttgcctgcgctcaggaaatgatgcagcagctttttgaacagggcatcaacatcgaccacatggtggttcccagtggcagcgcaggcacacatgcaggtattgttgtgggcatggccgccaccaattccggcattccggtaagcggcgtcaacgtgagccgcaccaaacctgttcaggaagagctggtgcataagctggcctgtgccactgcagaacgtgtcggcgtaagcggcggcattgcccgtgaagaagtggtatgctttgacggttacgtgggcgcaggatactctctgcccacagattccatggtcgaggctgtcaaactgcttgcttccaccgaaggcattctgctcgaccccgtatattccggtaaagccatggccggccttatcgaccttgtgcgcaaaggtcatttccccgaaggttcgaacgtgcttttcctgcataccggcggctcgcccgcgctgtatgcgtacaccgatacctttatggaataa

SEQ ID NO: 139 - protein, 333 aa, Desulfovibrio desulfuricans
  Desulfovibrio desulfuricans G20
MNLAKFPRRGYVQQATPIEKLDNFSAALGGKVQIYIKRDDLLPGCAGGNKTRKLDFCIADALEQGADTIITCGAVQSNHCRLTLAWAVKEGMDCHLVLEERVKGSYKPQGSGNNLLFHLMGVKSITVVPGGSDMMEAMTKVAGTLKEQGRNPYIIPGGASNTIGATGYVACAQEMMQQLFEQGINIDHMVVPSGSAGTHAGIVVGMAATNSGIPVSGVNVSRTKPVQEELVHKLACATAERVGVSGGIAREEVVCFDGYVGAGYSLPTDSMVEAVKLLASTEGILLDPVYSGKAMAGLIDLVRKGHFPEGSNVLFLHTGGSPALYAYTDTFME

SEQ ID NO: 140 - DNA, 945 bp, Thiomicrospira crunogena
  Thiomicrospira crunogena XCL-2
  CDS (1)..(945): transl_table=11
atgaaatcactcaacacgctccaagaatttacacctctcacacctctacaccatcccctgttcgacgaaaaagctgttcaggtttggataaaacgagatgatttaaatcatcctgccatccaaggtaacaaacttcataagctcaaatacaatttagcggaagccaggcaacaaggaaaacaaagtttactgacgtttggcggcgcttattcaaatcacatcgcggcgacggcggcagctggaaatgcatttggttttgaaaccattggcttcattcgaggggaggaacttgccaatcagcctgacaaatggagtccgacgttaaaaaacgcttatcagaatggaatgcaactgcactttttaaatagaatggattatcgccaaaagacacgcgctcattttttacaacaattacaacagcagtttcccaaaagttacattttaccggaaggcggtaccaacgacttggccatacaaggcttcgaagaactctcgcagcaattggccatgcaatgccctgattggagccacctttacagcgccgtgggcaccggcggaactttagcgggtttaatcaagttcagtgcttttttttgtgatcaaccacgtcttatttcaggcattgccaccttaaaacaagcgagctatttaatcccaacaatagagcagctcagtggcgttcatcacaatcagcgcggcttaacccagtggcaactactgttggactattgcgggcaaggctacggtaaagaagacagtgacattctcactgcacgaaaatggtttgaagaacagtttgacattccattagaccctgtgtacaccaataagatggtttatggcttcttggaagaactggctgcggataagattccagccggagccaaaatcattttatatcattccggcggattgcaaggccgcgctcttgaaaaaaaggcataa

SEQ ID NO: 141 - protein, 314 aa, Thiomicrospira crunogena
  Thiomicrospira crunogena XCL-2
MKSLNTLQEFTPLTPLHHPLFDEKAVQVWIKRDDLNHPAIQGNKLHKLKYNLAEARQQGKQSLLTFGGAYSNHIAATAAAGNAFGFETIGFIRGEELANQPDKWSPTLKNAYQNGMQLHFLNRMDYRQKTRAHFLQQLQQQFPKSYILPEGGTNDLAIQGFEELSQQLAMQCPDWSHLYSAVGTGGTLAGLIKFSAFFCDQPRLISGIATLKQASYLIPTIEQLSGVHHNQRGLTQWQLLLDYCGQGYGKEDSDILTARKWFEEQFDIPLDPVYTNKMVYGFLEELAADKIPAGAKIILYHSGGLQGRALEKKA

SEQ ID NO: 142 - DNA, 1083 bp, Shigella dysenteriae
  Shigella dysenteriae Sd197
  CDS (1)..(1083): transl_table=11
atgacaaaaaagggcgctttcactagcgccttttttatttacgtgttttcagcgtgcataataagaaaatcacaacaacacacatcggaggctgttatgccactgcataatttaacccgttttccacggttggagtttatcggcgcgccaacgccgctcgaatatctgccgcgcttttctgattatctaggacgggaaattttcatcaaacgggatgacgtcacccccatggcaatgggcggcaataaattacgtaagctagaatttctcgcggcagatgctctgcgcgaaggtgccgatacgctgattactgccggggcgatccagtctaaccatgtgcgccagactgccgcagtcgcggcgaaactcggactgcactgcgtggcgctgctggaaaatcctattggcacaaccgcagaaaactatttaaccaacggcaatcgtttgttgctggatctgttcaatacccagattgaaatgtgcgacgcactgaccgatcccaatgcccaactggaagagttggcgacgcgagtcgaagcacaaggctttcgcccatatgtcattccggttggcggttctaatgctctgggcgcgctaggttatgtggagagtgcgctggaaatcgcgcaacagtgtgaaggggcggttaatatttcgtcggtggtggtcgcatcgggcagtgccggaactcacgccggactggctgttgggctggaacacctgatgcctgaaagcgaactgattggcgtgaccgtgtcgcgttccgttgccgatcaattgccgaaagtggttaacctacaacaggcgattgcgaaagaactggagctgaccgcatcagcggaaattttactctgggatgactattttgcacctggctacggcgtgccgaacgacgaaggcatggaagcagtgaaattgctggcgcggctggaaggcattctgcttgatcctgtgtataccggaaaagcgatggcgggtctgattgacggtatcagtcagaaacgcttcaaagatgaagggccgattctgtttattcataccagcggtgcgcctgcgctgttcgcctatcatcctcacgtttag

SEQ ID NO: 143 - protein, 360 aa, Shigella dysenteriae
  Shigella dysenteriae Sd197
MTKKGAFTSAFFIYVFSACIIRKSQQHTSEAVMPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTSGAPALFAYHPHV

SEQ ID NO: 144 - DNA, 1083 bp, Shigella boydii
  Shigella boydii Sb227
  CDS (1)..(1083): transl_table=11
atgacaaaaaagggcgctttcactagcgccttttttatttacgcgttttcagcgtgcataataagaaaatcacaacaacacacatcggaggctattatgccactgcataatttaacccgttttccacggctggagtttatcggcgcgccaacgccgctcgaatatctgccgcgcttttctgattatcttggacgggaaattttcatcaaacgggatgacgtcacacccatggcaatgggcggcaataaattacgtaagctggaatttctcgcggcagatgccctgcgcgaaggtgccgatacgctgattactgccggcgcgatccagtctaaccatgtgcggcagactgccgcagttgcggcgaaactcggcctgcactgcgtggcgctgctggaaaatcctattggcacaaccgcagaaaactatttaaccaacggcaatcgtttgttgctgaatctgttcaatacccagattgaaatgtgcgacgcactgaccgatcccaatgcccaactggaagagctggcgacgcgagtcgaagcacaaggctttcgcccgtatgtcattccggttggcggttctaatgctctgggcgcgctgggttatgtggagagtgcgctggaaatcgcgcaacagtgtgaaggggcggttaatatttcgtcggtggtggtcgcatcgggcagtgccggaactcacgccggattggctgttgggctggaacacctgatgcctgaaagcgaactgattggcgtgaccgtgtcgcgttccgttgccgatcaattgccgaaagtggttaacctacaacaggcgattgcgaaagaactggagctgaccgcatcagcggaaattttactctgggatgactattttgcacctggctacggcgtgccgaacgacgaaggcatggaagcagtgaaattgctggcgcgtctggaaggcattctgcttgatcctgtgtataccggaaaagcgatggcggggctgattgacggtatcagtcagaaacgcttcaaagatgaagggccgattctgtttattcataccggcggcgcgcctgcgctgttcgcctatcatccccacgtttag

SEQ ID NO: 145 - protein, 360 aa, Shigella boydii
  Shigella boydii Sb227
MTKKGAFTSAFFIYAFSACIIRKSQQHTSEAIMPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLNLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTGGAPALFAYHPHV

SEQ ID NO: 146 - DNA, 942 bp, Hahella chejuensis
  Hahella chejuensis KCTC 2396
  CDS (1)..(942): transl_table=11
gtgtcctctctgctgtatcaacccgattgcgtcattcaaccgctcagtcaccctgtggctgagcgcgctggcgtgcgcctgtggatggcgcggggtgatttggttcatgagtctgtatccggcaacaagtggttcaagctcaaatacagcctgctggaggcggagcgaaatcaagcgtcgggattgttgagcttcggcggcgcctattccaaccacttgcatgcgctcgccgcagcgggccgtatgctgaatatccccacctttggcgtggtgcgcggcgcctggcgacgtgagctgacgccaactctgcaggatgccgagaagtgggggatgcgtttgctgttcgtcagcaatgaggcgtatcgctgcaaagatgatcctgcctgggtggaaggaagcattgcggactgggggctgtcagagctgatcgatacgcaaaagctgatgatcatccccgagggcggtagcaatacgctggcggtgaagggtgtatctgagtgggcgcagcaaatctattcctactttccctcgactcccgcatccatattcttgccttgcggcaccggcggtacgatggcggggtttgtcgccgctcactcacatcatgaggtggtcggtgtgcctgtgttgcgcgccggcgactctattgcagctaagatcgatgagttgctggctttgaataaccagcaaccagaaacctgttttcgctttatgcaaggttatgagtttggcggttacgccaagaccagccccgagctgatggccttcactcaagcattttccggtcacacgggcattggtttggagcctgtctacacgggaaagatggcgtatgcagcgctggagtggttgcgtcgaggcgaggctcctaaaggctcagacgttgtgcttgtgcatactggtggtatgcagggcgcgcgaggttttcttggtaagcgttaa

SEQ ID NO: 147 - protein, 313 aa, Hahella chejuensis
  Hahella chejuensis KCTC 2396
MSSLLYQPDCVIQPLSHPVAERAGVRLWMARGDLVHESVSGNKWFKLKYSLLEAERNQASGLLSFGGAYSNHLHALAAAGRMLNIPTFGVVRGAWRRELTPTLQDAEKWGMRLLFVSNEAYRCKDDPAWVEGSIADWGLSELIDTQKLMIIPEGGSNTLAVKGVSEWAQQIYSYFPSTPASIFLPCGTGGTMAGFVAAHSHHEVVGVPVLRAGDSIAAKIDELLALNNQQPETCFRFMQGYEFGGYAKTSPELMAFTQAFSGHTGIGLEPVYTGKMAYAALEWLRRGEAPKGSDVVLVHTGGMQGARGFLGKR

SEQ ID NO: 148 - DNA, 1017 bp, Burkholderia thailandensis
  Burkholderia thailandensis E264
  CDS (1)..(1017): transl_table=11
atgaatctccagaaattcccgcgttatccgctgaccttcggcccgacgccgatccagccgctcaagcggctctccgcgcatctcggcggcaaggtcgagctgtacgcgaagcgcgacgactgcaacagcggcctcgcgttcggcggcaacaagacgcgcaagctcgaatacctgatcccggatgcgctcgcgcaaggctgcgacacgctcgtgtcgatcggcggcatccagtcgaaccagacgcgccaggtcgcggcggtggccgcgcatctcggcatgaagtgcgtgctcgtgcaggagaactgggtcaactatcacgacgccgtctacgatcgcgtcggcaacatccagatgtcgcggatgatgggcgccgacgtgcgcctcgtgccggatggcttcgacatcggctttcgcaagagctgggaggacgcgctcgccgatgtccgcgcgaggggcggcaagccgtatgcgattccggccggctgctccgatcatccgctcggcggcctcggcttcgtcggcttcgccgaggaggtgcgcgcgcaagaggccgagctcggcttcaagttcgattacgtcgtcgtgtgctcggtgacgggcagcacgcaggccgggatggtcgtcgggttcgcggcggacgggcgcgcggatcgcgtgatcggcatcgacgcgtcggcgaagcccgcgcagacgcgcgagcagatccttcggatcgcgaggaataccgccgatcgcgtcgagctcggccgcgacatcgcgagcggcgacgtcgtgctcgacgagcgcttcggcggccccgaatacgggttgccgaacgagggcacgctcgaggcgatccggctgtgcgcaaagctcgaaggcgtgctgaccgatcccgtctacgaaggcaagtcgatgcacgggatgatcgagaaggtgcggctcggcgagtttcccgccggctcgaaggtgctgtacgcgcatctcggcggcgtgcccgcgctgaacgcgtacagcttcctgtttcgcgacggctga

SEQ ID NO: 149 - protein, 338 aa, Burkholderia thailandensis
  Burkholderia thailandensis E264
MNLQKFPRYPLTFGPTPIQPLKRLSAHLGGKVELYAKRDDCNSGLAFGGNKTRKLEYLIPDALAQGCDTLVSIGGIQSNQTRQVAAVAAHLGMKCVLVQENWVNYHDAVYDRVGNIQMSRMMGADVRLVPDGFDIGFRKSWEDALADVRARGGKPYAIPAGCSDHPLGGLGFVGFAEEVRAQEAELGFKFDYVVVCSVTGSTQAGMVVGFAADGRADRVIGIDASAKPAQTREQILRIARNTADRVELGRDIASGDVVLDERFGGPEYGLPNEGTLEAIRLCAKLEGVLTDPVYEGKSMHGMIEKVRLGEFPAGSKVLYAHLGGVPALNAYSFLFRDG

SEQ ID NO: 150 - DNA, 993 bp, Sodalis glossinidius
  Sodalis glossinidius str. 'morsitans'
  CDS (1)..(993): transl_table=11
atgagcgatcttgcccaacggttggccggcgttccccggctggatattatcggcccgccgacgccgctcgaacatctcccccggctgtcggactttctggcgcgggatatctttatcaagcgcgacgatttaaccccgctgggcctgggcggtaacaagttgcgcaagctggagtacctggccgctgacgcgctgcgccagggtgccgacacgttgctgaccgccggtgctatccagtcgaaccacgtgcggcaaacggcggcgctggcggccaaattggggctgcattgcgtcgcgctgttggaaaagccgatcgacacacccgccggtaactacctgaccaacggcaaccgtctgttgctcgatttgtttcagtgcgaggtcatcgcgtgcgaggccctgactcagcctgctcaacagctggccgatgcgtcgctgcgtctggaggcacagggctttcggccctatgtcataccagtggggggatccaacgccctgggctcgctgggttacgtcggttgtgcgctggagatagcccatcagtgtcaaggtgtgatccagccgggcgcggtagtggtgtcatcgggcagcggcggcacgcacgcgggactggaggtcggtctggccgccgtgctgccggaaacggcgtttatcggcgttaccgtttcgcgtcgctcggaacagcagcggcctcttatcgccagtctggcagcgcaagtgagtgaacagttgtctctcgccgcgccggccgcggagataaccctgtgggatgagtattttgcccccggttatggccagctcaatgacgagggccgcgaggcgattgcgctattagcgcgtctggagggcattgtgctggatccggtttatgccggtaaggccatggcagggctgattgatggccttgaacgcgaccgttttcctgacgggccactggtgtgttcgtgcataccggcggcgctgtttgcttatcattatctggagacccgatga

SEQ ID NO: 151 - protein, 330 aa, Sodalis glossinidius
  Sodalis glossinidius str. 'morsitans'
MSDLAQRLAGVPRLDIIGPPTPLEHLPRLSDFLARDIFIKRDDLTPLGLGGNKLRKLEYLAADALRQGADTLLTAGAIQSNHVRQTAALAAKLGLHCVALLEKPIDTPAGNYLTNGNRLLLDLFQCEVIACEALTQPAQQLADASLRLEAQGFRPYVIPVGGSNALGSLGYVGCALEIAHQCQGVIQPGAVVVSSGSGGTHAGLEVGLAAVLPETAFIGVTVSRRSEQQRPLIASLAAQVSEQLSLAAPAAEITLWDEYFAPGYGQLNDEGREAIALLARLEGIVLDPVYAGKAMAGLIDGLERDRFPDGPLVCSCIPAALFAYHYLETR

SEQ ID NO: 152 - DNA, 1023 bp, Anaeromyxobacter dehalogenans
  Anaeromyxobacter dehalogenans 2CP-C
  CDS (1)..(1023): transl_table=11
atgccggccacccgcgaacccgccaccctgaacctgcccccgcgcgtgccgctcgcccggctgcccacgcccatcgagccgtcgccgcggctcggggccgcgctcgggctcgacctcctctacaagcgcgacgacctcaccggcctcgagctgtccggcaacaaggcgcggaagctggagtacctgctcgccgaggccgaggcggcgggggcggacacggtggtcacctgcggcggcgtgcagtccaaccactgccgcgccacggcgttcgcggccgcgaagcgcgggctgcgcgcggtgctcctgctgcgcgtgccggacccggcgcggccgcccgcgcccgaggcgaacgtgctgctcgatctcctggccggcgcggagctccgctgggtctcgcacgacgagtaccggcgccgcgccgagcgcatggacgcggtggcctcggagctgcgcgcggccgggcggcgggcctacgtgatcccggagggcggctcgtcgccgctggggagcctgggctacctgctggccgtggcggagctgcggcggcagctcccggaggcgtggcggagcgggccgctgacgctcgcctacgccgcgggctcgggcggcaccggcgccgggctcgagctcggggtgcgcgcgctggggtggaaggacgcgcgaccggtgggcttcgcggtgtgcaacgacgcggcgtacttccgcgcgacgatcgcggcgctgtgcgccgacgcgcgccggcggtggccggcgctgcccgaggtgcccgcggacgagatccggatcgacgacgggttcatcggcccgggctacgcccaggcgacgccggaggggctggagatcatccgccgcgcggcgcgcgaggacggggtgctcctcgatccggtctacaccggaaaggcgatgctcggtctggccgcgcgggcgcgcgagccgggtggcctgcccgcgccgcgcgtcgtgttcttccacaccggcggcgcgttcggcctcttcccgttcgcgagcgcgctgaccggctga

SEQ ID NO: 153 - protein, 340 aa, Anaeromyxobacter dehalogenans
  Anaeromyxobacter dehalogenans 2CP-C
MPATREPATLNLPPRVPLARLPTPIEPSPRLGAALGLDLLYKRDDLTGLELSGNKARKLEYLLAEAEAAGADTVVTCGGVQSNHCRATAFAAAKRGLRAVLLLRVPDPARPPAPEANVLLDLLAGAELRWVSHDEYRRRAERMDAVASELRAAGRRAYVIPEGGSSPLGSLGYLLAVAELRRQLPEAWRSGPLTLAYAAGSGGTGAGLELGVRALGWKDARPVGFAVCNDAAYFRATIAALCADARRRWPALPEVPADEIRIDDGFIGPGYAQATPEGLEIIRRAAREDGVLLDPVYTGKAMLGLAARAREPGGLPAPRVVFFHTGGAFGLFPFASALTG

SEQ ID NO: 154 - DNA, 1029 bp, Jannaschia sp.
  Jannaschia sp. CCS1
  CDS (1)..(1029): transl_table=11
atgcatcctcgcttgcccatcgtcaccgcccccaccccgctggaccccgccgaaaatctgtccgcgcatcttgggatagacctgcacatcaaacgcgatgaccttgccgggcccacattgggcggcaacaaggcgcggcaattggaatattactttggcgcggcacaggccgagcgggcggatgtgatcctgatcaccggggcggtccagtccaacttcgcgcgcctcgcggtggccatcgcgcggcgacaggggatggaggcagtgatccagctggaggaccgcgtgccgggcaaacccgcgcagtaccgcgcaggcggcaatgtgcttctgtctcggttgatgggggcggagatcctcaactaccccgagggggaggatgaagcgggcgccgatgccgcccttcacaccaaggcagaggcgttgcgcgcggagggcaagcggccctatgtgattcacctgtcggaagggcacccgccgctgggggcgctgggatatgtggatgcggcccatgagatcctggcgcagaagtctgacttcgacatcttcgtcgtggcatcgggcagcggatcgacccatgcggggctattagccgggctgcggggggccggatgcacggcccctgtcatcgggtcctgcgtgcggcgcgcggcatcggtgcagacgccccggatcaggcgcgtgactgaccgattggccaagctacacgacggcgcgacgcgggtcacggacgcggatatcatcacatgggacggggccttgtcgccgggatatggccagttgggaccagccgcgcgggacgcgatggagatgatggcgcgccatgaggggctgatgctggacccggtctataccgccaagagtttcgccgcgatcccggcccttgtggccagcggcgagatccccaagggcagccgggtgtgtttcgtgcataccggcgggctggcggctttgtttgcctatgaggccgcgctgacagaggggcttgaagcgcggcctacggatcttccagacgcggcgcggcgctga

SEQ ID NO: 155 - protein, 342 aa, Jannaschia sp.
  Jannaschia sp. CCS1
MHPRLPIVTAPTPLDPAENLSAHLGIDLHIKRDDLAGPTLGGNKARQLEYYFGAAQAERADVILITGAVQSNFARLAVAIARRQGMEAVIQLEDRVPGKPAQYRAGGNVLLSRLMGAEILNYPEGEDEAGADAALHTKAEALRAEGKRPYVIHLSEGHPPLGALGYVDAAHEILAQKSDFDIFVVASGSGSTHAGLLAGLRGAGCTAPVIGSCVRRAASVQTPRIRRVTDRLAKLHDGATRVTDADIITWDGALSPGYGQLGPAARDAMEMMARHEGLMLDPVYTAKSFAAIPALVASGEIPKGSRVCFVHTGGLAALFAYEAALTEGLEARPTDLPDAARR

SEQ ID NO: 156 - DNA, 1011 bp, Saccharophagus degradans
  Saccharophagus degradans 2-40
  CDS (1)..(1011): transl_table=11
atgcctatgacaacttatcgacctgccaaaacttcacttgctaaccttcctacagcgctccagccattagatcgtgtttctcaaattttgggcggcccgcgtatttggcttaaaagagatgatctaacgggctctacgttaagcggcaacaaggtgcgtaaattagagtacgtggtggctgaggcgctctcaaacggcgcagatacgctaatcacttgcggcgggctgcaatctaaccattgtagagctacggcgctggtggcggctcaactcggtttaaaggcccaccttatattgcgcggccaacaaaagggcagtgctgccgatggcaacctactgctagatgaccttgcaggtgctcagatatctcaatattcagttgcagactattccaaaaatctaacatcgttattctcccattggcagaaccattacgcgcagcaggggcgcaaggcgtggtgtattcctactggggcaagcgatgaaataggtatttgggggtatattgatgcgtttgctgagctagaagctcagttggcagagcgagatattaaccctgatttggtggtatgcgccacaggttcgggcgggacacaggctggattaagtttaggggcccacatattggggagtaaagcaaaggttgtgggtatggctgtgtgcgactcagaggcttactttgagcgcaaagctaaacaagatataaccctgtggcagcaaaagtacgggcaggcagctggaatatctgctcagcaagctactcaggtacaaataaatactatcgataaatatattggcccaggatatgcaaaagcctaccctgagttgctggagcgtattcgctggttggcagccaccgaaggggtggtgctagaccccgtttacacaggcaaagcattttatgggttggtgcaagaaattaaatcggggcgctgggcaaatatgaaagacattgtatttgtacacactggggggatttttggccttttcccctatagagatgaattttag

SEQ ID NO: 157 - protein, 336 aa, Saccharophagus degradans
  Saccharophagus degradans 2-40
MPMTTYRPAKTSLANLPTALQPLDRVSQILGGPRIWLKRDDLTGSTLSGNKVRKLEYVVAEALSNGADTLITCGGLQSNHCRATALVAAQLGLKAHLILRGQQKGSAADGNLLLDDLAGAQISQYSVADYSKNLTSLFSHWQNHYAQQGRKAWCIPTGASDEIGIWGYIDAFAELEAQLAERDINPDLVVCATGSGGTQAGLSLGAHILGSKAKVVGMAVCDSEAYFERKAKQDITLWQQKYGQAAGISAQQATQVQINTIDKYIGPGYAKAYPELLERIRWLAATEGVVLDPVYTGKAFYGLVQEIKSGRWANMKDIVFVHTGGIFGLFPYRDEF

SEQ ID NO: 158 - DNA, 978 bp, Saccharophagus degradans
  Saccharophagus degradans 2-40
  CDS (1)..(978): transl_table=11
gtgcctaacccttctttgttaaacctattaacaggtgatctacctcaactcgcagctactgtgcaacaccagcggctcaattggcgtgtggccgatgaagcgggtgttgcggtttatttgcgtcgagacgacgctattcacgctaagcttagcggtaacaagctttacaaattgcacgggcatttgcaggcttattttgaaagcgcccattctaagcaacccattgcctcatttggtggggcatactctaatcacctctacgccttagcagccgctgggcaaattttagggattcccacaattgcggtaattcgtggtgagcgacccaaaggcgcagcgccaactttagatgatcttgaggcaatgggtatgcggttacattttattagccgtgaacgttacaagctgcgtaatgatcaggccctactgatggctctcaatctcgagttaggagaaccttgtttttgggtgcccgaaggaggggctgggttgctgggtaatactggctgccaagtgttgggggcatcctgcagtgagtttctgcagcgcgttacgccgaatgagagcgatgcttatgtggtgatggcttgtggcacaggtacaacctttagcggcgttgttaatggcgtggggccttctgtgcaggtgttgggcgtgccagtgctaaaggtgggtggcgaatataaagccgaaattgctgctgccataggtgcgaatacccgctggaagcttttagaggatgggcattgtggtggttacgccaagtttccagaatacctgctaaagtttatggtagaaacagaattagaagttggcgtgcaattagacccagtgtatacggcgaaaatgctgtacagtctggcaacagcgattaagcagggtaagtttgcaagaggtagccatattgtggctattcactctggtggcttacaaggtaggcgcagtgtggagaagcaattaatggagttgtatgtatga

SEQ ID NO: 159 - protein, 325 aa, Saccharophagus degradans
  Saccharophagus degradans 2-40
MPNPSLLNLLTGDLPQLAATVQHQRLNWRVADEAGVAVYLRRDDAIHAKLSGNKLYKLHGHLQAYFESAHSKQPIASFGGAYSNHLYALAAAGQILGIPTIAVIRGERPKGAAPTLDDLEAMGMRLHFISRERYKLRNDQALLMALNLELGEPCFWVPEGGAGLLGNTGCQVLGASCSEFLQRVTPNESDAYVVMACGTGTTFSGVVNGVGPSVQVLGVPVLKVGGEYKAEIAAAIGANTRWKLLEDGHCGGYAKFPEYLLKFMVETELEVGVQLDPVYTAKMLYSLATAIKQGKFARGSHIVAIHSGGLQGRRSVEKQLMELYV

SEQ ID NO: 160 - DNA, 987 bp, Escherichia coli
  Escherichia coli UTI89
  CDS (1)..(987): transl_table=11
atgccactgcataatttaacccgttttccacggctggagtttatcggcgcgccaacgccgctcgaatatctgccgcgcttttctgattatcttggacgggaaattttcatcaaacgggatgacgtcactcccatggcaatgggcggcaataaattacgtaagctggaatttctcgcggcagatgctctgcgtgaaggtgccgatacgctgattactgccggggcgatccagtctaaccatgtgcgccagactgccgcagtcgctgcgaaactcggtctgcattgcgtggcgctgctggaaaatcctattggtacaaccgcggaaaactatttaaccaacggcaatcgtttgttgctggatctgttcaatacccagattgaaatgtgcgacgcactgaccgatcccaatacccaactggaagagctggcgacgcgagtcgaagcacaaggctttcgcccgtatgtcattccggttggcggttctaatgctttgggcgcgctgggttatgtggagagtgcgctggaaatcgcgcaacagtgtgaaggggcagttaatatttcgtcggtggtggtcgcatcgggcagtgccggaactcacgccggactggctgttgggctggaacacctgatgcctgaaagcgaactgattggcgtgactgtgtcgcgttctgttgccgatcaattgccgaaagtggttaacctccaacaggcgattgcgaaagaactggagctgaccgcatcagcggaaattttactctgggatgactattttgcacctggctacggcgtgccgaacgacgaaggcatggaagcagtgaaattgctggcgcggctggaaggcattctgcttgatcctgtgtataccggaaaagcgatggcggggctgattgacggtatcagtcagaaacgcttcaaagatgaagggccgattctgtttattcataccggcggtgcgcctgcgctgttcgcctatcatccccacgtttag

SEQ ID NO: 161 - protein, 328 aa, Escherichia coli
  Escherichia coli UTI89
MPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNTQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTGGAPALFAYHPHV

SEQ ID NO: 162 - DNA, 1038 bp, Polaromonas sp.
  Polaromonas sp. JS666
  CDS (1)..(1038): transl_table=11
atggacctgagccgctttcctcgtcgccgttacacccaggggccgaccccgctggagttcctgccccacttcactgaagcactccgcgccacctgccccgagggcagcggccccaatatctggatcaaacgcgacgacatgctgggcctgacgcccggcggcaacaagacgcgcaagctggagttcctggctgctgacgcactggcccagggtgccgacacgctgataacctgcggcgcgccacagtccaaccactgccgcgccacactgtgcgcggccatcaaggaagggctcaaatgccgcttcgtgattgaagaacgggtgcccaacagctaccgggaaaatgccagcggcaacaactttcttttccgcctgctgggcgtcgaggccatcaccgtcgtgcctgcgggcaccaacatgatggaggccatgcagaaagtcgccgccgacctggccaaagaaggccgcaagggctacatcgtgccgggcggtggttccaacgccattggcggtctgggttatgtggcctgcgcgcaggagctgcagcagcagtttttcgagcagggcgtgcagatcgacaagatcgtcgtgggctcgggcagctcgggcacgcacggtggcctgctggccggcttcctgggcaaccacatccatattcccctgatcggcattggtgtgagccgcgacccggtggaccaggatcccctcgtgcacaaggaggcccaggccgtggccgacctgctgggcctgaatatgaccattccgcgcgaagcggtcgtgagctatggcgactggtggaggcccaagtattcggtacccaaccaggccatggtcgaagccgtgcagatgctggcgcgcaccgaggccattctgctggacccggtgtacaccggcaagatcatggccgggctgatcggactggcgcgcaaaggccatttccgccgtgatgaaaacgtgctgttcattcacaccggaggggcaccgtcgctgcatgcctacgaagccgaggtgctgggcctgaccgagctgccggcctga

SEQ ID NO: 163 - protein, 345 aa, Polaromonas sp.
  Polaromonas sp. JS666
MDLSRFPRRRYTQGPTPLEFLPHFTEALRATCPEGSGPNIWIKRDDMLGLTPGGNKTRKLEFLAADALAQGADTLITCGAPQSNHCRATLCAAIKEGLKCRFVIEERVPNSYRENASGNNFLFRLLGVEAITVVPAGTNMMEAMQKVAADLAKEGRKGYIVPGGGSNAIGGLGYVACAQELQQQFFEQGVQIDKIVVGSGSSGTHGGLLAGFLGNHIHIPLIGIGVSRDPVDQDPLVHKEAQAVADLLGLNMTIPREAVVSYGDWWRPKYSVPNQAMVEAVQMLARTEAILLDPVYTGKIMAGLIGLARKGHFRRDENVLFIHTGGAPSLHAYEAEVLGLTELPA

SEQ ID NO: 164 - DNA, 1029 bp, Polaromonas sp.
  Polaromonas sp. JS666
  CDS (1)..(1029): transl_table=11
atgcaactcacgctcaacctcaaaaagtttcccagacattcgttgaccttcggccccacgcccatccagccgctcaggcgcctgagcgcccacctgggcggcaaggtcgagctgtacgccaaacgcgaagactgcaacagcggcctggcctttggcggcaacaaaacccgcaagctggagtacctgatccccgaggcgctggcgcaaggctgcgacacgctggtctccatcggcggcatccagtccaaccagacgcgccaggtggcggccgtggccgcgcacctgggcatgaagtgcgtgctggtgcaggagaactgggtgaactattccgacgccgtgtacgaccgcgtcggcaatatcgagatgtcgcgcatcctgggcgccgacgtgcgcctggatgcggccggttttgacatcggcattcgccccagctgggagcaggccatggacgacgtgcgcaaagccggtggcaagcccttccccattccggccggctgctccgaacatccttatggcggcctgggctttgtcggctttgccgaagaagtgcgggcgcaggaagctgaactcggcttcaggttcgactacatcgttgtctgctcggtcaccggcagcacgcaggccggcatggtggttggttttgccgccgacggccgtgccgaccgcgtgatcggcatagacgcctctgccaagcctgagaagaccaaggcgcaaatcctgcgcatcgcaaagaacaccgccaggctggtcgagctggatcgcgacatcaccgcgaaagacgtggtgctcgacacccgctacggcgggcccgaatacggcctgccgaacgaaggcacgctggaggccattcgcctgtgcgcccggcaggagggcatgctgacggacccggtctacgagggcaagtccatgcacggcatgatcgacatggtgcgccgcggtgagttcgccgaggggtccaaggtgctgtatgcccacctgggtggcgtgcccgcgctcaatgcgtacagcttcctgttccgcaacggctga

SEQ ID NO: 165 - protein, 342 aa, Polaromonas sp.
  Polaromonas sp. JS666
MQLTLNLKKFPRHSLTFGPTPIQPLRRLSAHLGGKVELYAKREDCNSGLAFGGNKTRKLEYLIPEALAQGCDTLVSIGGIQSNQTRQVAAVAAHLGMKCVLVQENWVNYSDAVYDRVGNIEMSRILGADVRLDAAGFDIGIRPSWEQAMDDVRKAGGKPFPIPAGCSEHPYGGLGFVGFAEEVRAQEAELGFRFDYIVVCSVTGSTQAGMVVGFAADGRADRVIGIDASAKPEKTKAQILRIAKNTARLVELDRDITAKDVVLDTRYGGPEYGLPNEGTLEAIRLCARQEGMLTDPVYEGKSMHGMIDMVRRGEFAEGSKVLYAHLGGVPALNAYSFLFRNG

SEQ ID NO: 166 - DNA, 1017 bp, Burkholderia xenovorans
  Burkholderia xenovorans LB400
  CDS (1)..(1017): transl_table=11
atgaatctgcaacgatttcctcgttacccgctgactttcgggccgacgccgatccaaccgctagcgcgtctgagcaagcatctcggcggcaaagtgcatctgtatgcgaaacgcgaggactgcaacagcggtcttgccttcggcggcaacaagacacgcaaactcgaatatctgatccctgaagtgcttgcgcagggttgcgacacgctcgtgtcgatcggcggcatccagtcgaaccagacgcgccaggtggcggccgtggcagcgcatctgggcatgaaatgcgtgctggtacaggagaactgggtcaactactcggacgcggtctacgaccgggtcggcaacatccagatgtcgcgtattctcggcgccgatgtgcgcctcgtgcccgacggcttcgacatcggctttcgcaagagctgggaggaggcgctcgaaagcgtgcgcgccgccggcggcaaaccgtatgcgattccggccggctgctcggaccatccgctcggcggcctcggtttcgtcggcttcgcggaagaggtgcgtcagcaggaagccgaattgggcttcaagttcgactacgtcgtggtgtgttccgtaaccggcagcacgcaagccggcatggtggtgggttttgccgccgacggccgcgctgatcgcgtgatcggcatcgacgcatcggcaaagcccgcgcagacgcgcgagcagatcacgcgaatcgcccggcaaacggcggaaaaagtcggcctgggccgcgatatcacgagcgaagacgtggtgctcgacgagcgcttcgccggtccggaatacggcctgccgaatgacggcacgctggaagcaatccgcttgtgcgcccgcatggagggcgtgctgaccgatcccgtctacgaaggcaaatccatgcacggcatgatcgagatggtgcgcaacggcgaatttccggaaggttcgcgcgtgctgtatgcgcacctcggcggcgtgccggcgttgaacggctacagcttcattttccgcaacggctaa

SEQ ID NO: 167 - protein, 338 aa, Burkholderia xenovorans
  Burkholderia xenovorans LB400
MNLQRFPRYPLTFGPTPIQPLARLSKHLGGKVHLYAKREDCNSGLAFGGNKTRKLEYLIPEVLAQGCDTLVSIGGIQSNQTRQVAAVAAHLGMKCVLVQENWVNYSDAVYDRVGNIQMSRILGADVRLVPDGFDIGFRKSWEEALESVRAAGGKPYAIPAGCSDHPLGGLGFVGFAEEVRQQEAELGFKFDYVVVCSVTGSTQAGMVVGFAADGRADRVIGIDASAKPAQTREQITRIARQTAEKVGLGRDITSEDVVLDERFAGPEYGLPNDGTLEAIRLCARMEGVLTDPVYEGKSMHGMIEMVRNGEFPEGSRVLYAHLGGVPALNGYSFIFRNG

SEQ ID NO: 168 - DNA, 1023 bp, Psychrobacter cryohalolentis
  Psychrobacter cryohalolentis K5
  CDS (1)..(1023): transl_table=11
atgcaaaataaatctataccaagcctgccgagtatgaatcggcaacctttagggtttttcccaacgccgttgattgagctgaccagattaagcaaagcactcgatggtcctaaaatttatatgaaacgcgatgacaatacgggactggcattaggcggtaataaaaccagaaagcttgaatttatcattggggacgctcttgctcaaggtgcggatacaatcgtgacagcaggtgccgcgcagtcaaaccattgtcgccagaccgcagctgccgcagccagtttgggacttgaatgccatttagttttgggtggacaagaaccagaacagttgcaaggcaatctcttactggataagatttttggctgtcatatccactgggcaggcagcaaccgtaaaggggaagacatacctgatatcgtagaacaactcaaaaaagaaggtaagaaaccttacattgttccttatggcggctcaagcgagctcggtgcttttgcctttgttgaagcgtttaaagagcttgaattacaacgtcaagagatggatatctcattcacgcatatcgtttttgcctccagctccggcgggacacaagcgggcttgatgctgggcaataaaatctttaactcgccttatcaggtagtgggcatcaatattgataaaagtgaaaccgataaagtgccgtttgatcagtatatcatctccctcaccaatagcacggcggcattgattggggcagattacaccttctcagaggcagatttagtgcttaactctgattatgtgggagacggttatggagtgattggtgcactagaaaatgaagccattgccatgaccgcgcaaatggaagggatattattagatcctgtttatacaggtcgtgcgatgggcggactactcgatatgattcgtaccggtaaaatcaaaaaaacggacagtgtgttgttttggcatactggcggcgcgcccgctttatttgcttatgctagtgatttagcagtatctcaaagcgatagttaa

SEQ ID NO: 169 - protein, 340 aa, Psychrobacter cryohalolentis
  Psychrobacter cryohalolentis K5
MQNKSIPSLPSMNRQPLGFFPTPLIELTRLSKALDGPKIYMKRDDNTGLALGGNKTRKLEFIIGDALAQGADTIVTAGAAQSNHCRQTAAAAASLGLECHLVLGGQEPEQLQGNLLLDKIFGCHIHWAGSNRKGEDIPDIVEQLKKEGKKPYIVPYGGSSELGAFAFVEAFKELELQRQEMDISFTHIVFASSSGGTQAGLMLGNKIFNSPYQVVGINIDKSETDKVPFDQYIISLTNSTAALIGADYTFSEADLVLNSDYVGDGYGVIGALENEAIAMTAQMEGILLDPVYTGRAMGGLLDMIRTGKIKKTDSVLFWHTGGAPALFAYASDLAVSQSDS

SEQ ID NO: 170 - DNA, 975 bp, Nostoc punctiforme
  Nostoc punctiforme PCC 73102
  CDS (1)..(975)
atgtctgtaatattttttccacctcccatacaacaaatcaacagcgaaatcatccgtagcgctggtgttgatctgtatgtactacgcctggatctcatgcacccgtgggttaacggcaataagtggttcaagctgaaatacaatcttttggaggccaaggagaaaaatttcacaacgctgcttacttttggcggcgcttattccaatcacatctatgcaactgcggcggctggtaatcttttcggttttcgtaccatcggcgtaattcgtggggaggagagactaccattaaacccgacgctgaattttgctgtacaacagggtatgcagcttgtgtatacgaaccgcgaaatgtatcgacagcgcaacacaccagtggtagaggaatatctgcaacaacgcttcggtgaagtgtttatcattcccgaaggcgggagtaatttaaatggtgtgcgcggctgtatggagatcattggtgatgcgatgtctacggcggtcactgaacgcagtcgaagtgctggctacgcctacgcatttgatcgtatatgcgtagcctgcggtacagctaccacacttactgggattgcgctttcattgcatcaaggacaaagagcgatcgcttttcccgttctgaaaaatggctcatttcttgcacaagaaatcgaaagtctgctgacaaattacctcgcctctgatttacccacaccatctaactcccctgctttttgggaattggtatgtgattaccactttggcggctatgcaaaggtgaacaaggagttattattgttcagccaacagttcagggaggaacatggcatacctcttgattacgtatataccgccaaaatgttttacggtgtgatggatttactaaaacagggattttttagtaaaggcgattcgttgctgctggtacacacaggaggcttacagggcaatgtcggcatggaagaaaggtttcaaagaatgtag

SEQ ID NO: 171 - protein, 324 aa, Nostoc punctiforme
  Nostoc punctiforme PCC 73102
MSVIFFPPPIQQINSEIIRSAGVDLYVLRLDLMHPWVNGNKWFKLKYNLLEAKEKNFTTLLTFGGAYSNHIYATAAAGNLFGFRTIGVIRGEERLPLNPTLNFAVQQGMQLVYTNREMYRQRNTPVVEEYLQQRFGEVFIIPEGGSNLNGVRGCMEIIGDAMSTAVTERSRSAGYAYAFDRICVACGTATTLTGIALSLHQGQRAIAFPVLKNGSFLAQEIESLLTNYLASDLPTPSNSPAFWELVCDYHFGGYAKVNKELLLFSQQFREEHGIPLDYVYTAKMFYGVMDLLKQGFFSKGDSLLLVHTGGLQGNVGMEERFQRM

SEQ ID NO: 172 - DNA, 900 bp, Pseudomonas aeruginosa
  Pseudomonas aeruginosa UCBPP-PA14
  CDS (1)..(900)
ttgcagcgtctcgaactcgactggctgcaacgggccggggtcgaactggcgctgctgcgcctggaccaggccgatccgttgatctccggcaacaaggggttcaagctcgcgccacacctggcgctggcccgcgagcaggggctggacggcctgatcagcctcggcggcgcccactccaaccacctgcacgcgctggccggcgccggcgcgcgtttcgatttccgttgcgtcggcctgttgcgcggacacgaagtcgatacgccgacggtgcgcgacctgcgcagtctcggcatggaactgcactggctcggctacggcggctatcgccagcggcatgccgccggtttctggcttccctggcgggaacgttacccaggcttgctgccggtcgccgagggcggtggcgggctgctgggcgcgcgcggttgcatcgggctggtggagcgcatagcgacccagttgccgacgctcggctgggacgattacgacgcgatctgggtggccgccggtaccggtacgacactggccggcctggtgctcggcgaggctgggcggcatcccgtggtgggcgcgctggcggtgccggaggaccacggcgtcgccgcccaggtcgcggcgacccttgccgaggcgggctgggccgataccggctatcgcctgctggacgccagccgtggcggtttcgcctgtctcgatgggaggttggcgcggttcatcgtcgagttcgagacggccagcggcgtcgccctcgaaccgctgtacaccggcaaactgctgctcgccctgcgcgaggccgtggagagcggcgcggtggctcgcggcagccggctggtggcgctgcacagcggaggcctgcagggccgccgggcattgcaggagcgtttgctggcgttgctctga

SEQ ID NO: 173 - protein, 299 aa, Pseudomonas aeruginosa
  Pseudomonas aeruginosa UCBPP-PA14
MQRLELDWLQRAGVELALLRLDQADPLISGNKGFKLAPHLALAREQGLDGLISLGGAHSNHLHALAGAGARFDFRCVGLLRGHEVDTPTVRDLRSLGMELHWLGYGGYRQRHAAGFWLPWRERYPGLLPVAEGGGGLLGARGCIGLVERIATQLPTLGWDDYDAIWVAAGTGTTLAGLVLGEAGRHPVVGALAVPEDHGVAAQVAATLAEAGWADTGYRLLDASRGGFACLDGRLARFIVEFETASGVALEPLYTGKLLLALREAVESGAVARGSRLVALHSGGLQGRRALQERLLALL

SEQ ID NO: 174 - DNA, 996 bp, Bacillus cereus
  Bacillus cereus G9241
  CDS (1)..(996): transl_table=11
atgaatttagctaaattcccgagaaaaaaatatacagagtcatatacaccaattgaaaaattaaacaatttttctgaagcacttggtggaccgactatttattttaaacgagatgatttacttggtttaacagctggtggtaataagacgagaaagttagagtttctagttgcggatgcacaggcaaagggtgcagatacgttaattacggctggtggtattcagtcaaatcattgccgcctgacactggcagctgcggtgaaagagaaaatgaaatgtattcttgtattagaagaagggcttgagccagaagagaagccagattttaacggaaactatttcttatatcatttattaggtgctgaaaatgtaattgttgtacgaaatggagcagatcttatggaagagatgcataaagtagcgaaagaagttagtgaaaaagggaatacaccatatgtcattccagttggtggatcaaatcctactggcgcaatgggatacattgcttgtgcgcaagaaattatggcgcaatcatttgaccaaggaattgatttcagttcagtcgtttgcgtaagcggtagcggcggtatgcacgccggtttaattacaggttttgctggaacacaaagtcacatcccagtaatcggaattaacgtaagtagaggaaaagcagagcaagaagagaaagtagcaaaacttgtagatgaaacttcagctcacgttggtattccaaactttatcccgcgcgaagctgttacatgctttgatgaatatgtaggaccaggttacgcgttaccaacgccagaaatggtggaagcagtgcagctgttagcaaaaacagaaggtattttactggatccagtgtatacgggtaaagcggtagcgggactaatcgatttaattaaaaaaggtacatttaaaaaagaagacaacattttattcgtacattcaggtggttcaccagctttatatgcgaatacgtctttatttgcgtaa

SEQ ID NO: 175 - protein, 331 aa, Bacillus cereus
  Bacillus cereus G9241
MNLAKFPRKKYTESYTPIEKLNNFSEALGGPTIYFKRDDLLGLTAGGNKTRKLEFLVADAQAKGADTLITAGGIQSNHCRLTLAAAVKEKMKCILVLEEGLEPEEKPDFNGNYFLYHLLGAENVIVVRNGADLMEEMHKVAKEVSEKGNTPYVIPVGGSNPTGAMGYIACAQEIMAQSFDQGIDFSSVVCVSGSGGMHAGLITGFAGTQSHIPVIGINVSRGKAEQEEKVAKLVDETSAHVGIPNFIPREAVTCFDEYVGPGYALPTPEMVEAVQLLAKTEGILLDPVYTGKAVAGLIDLIKKGTFKKEDNILFVHSGGSPALYANTSLFA

SEQ ID NO: 176 - DNA, 1017 bp, Rubrivivax gelatinosus
  Rubrivivax gelatinosus PM1
  CDS (1)..(1017)
atgaacctccagcgcttccctcgccatccgctcaccttcgggcccacgcccatccagccgctcaagcgcctgagtgcgcacctcggcggccaggtcgagctctacgccaagcgcgaggactgcaacagcggcctcgccttcggcggcaacaagacccgcaagctcgagtacctgatccccgaggcgctggcgcagggctgcgacacgctggtgtcgatcggcggcatccagtccaaccagacgcgccaggtcgccgcggtggcggcccacctcggcatgaagtgcgtgctggtgcaggagaactgggtcaactactccgacgcggtgtacgaccgcgtcggcaacatcgagatgtcgcgcatcctcggcgccgacgtgcggctcgacgccgctggcttcgacatcggcatccgcccgagctgggagcaggcgatggccgacgtgcgggccgccggcggcaagcccttccccattcccgccggctgctccgagcaccggctcggcggcctgggcttcgtcggcttcgccgaggaggtgcgcgcgcaggaggccgagctcggcttcaagttcgactacatcgtggtctgctcggtgaccggcagcacgcaggccggcatggtggtgggcttcgcggccgacggccgggccgagcgcgtgatcggcatcgacgcctcggccaagcccgagcagacccacgcgcagatcctgcgcatcgcgcagaacacggccgagctggtgggcctgggccgcgagatcaccgcgcaggacgtggtgctcgacacccgctacggcggccccgagtacggcctgccgagcgagggcacgctggaggccatccgcctgtgcgcgcgccaggaaggcatgctcaccgacccggtgtacgagggcaagtcgatgcacggcatgatcgacaaggtgaagcgcggcgagttccccgccggctccagggtgttgtacgcccacctcggcggcgtgccggcgctcaacgcctacagcttcctgttccgcaacggctga

SEQ ID NO: 177 - protein, 338 aa, Rubrivivax gelatinosus
  Rubrivivax gelatinosus PM1
MNLQRFPRHPLTFGPTPIQPLKRLSAHLGGQVELYAKREDCNSGLAFGGNKTRKLEYLIPEALAQGCDTLVSIGGIQSNQTRQVAAVAAHLGMKCVLVQENWVNYSDAVYDRVGNIEMSRILGADVRLDAAGFDIGIRPSWEQAMADVRAAGGKPFPIPAGCSEHRLGGLGFVGFAEEVRAQEAELGFKFDYIVVCSVTGSTQAGMVVGFAADGRAERVIGIDASAKPEQTHAQILRIAQNTAELVGLGREITAQDVVLDTRYGGPEYGLPSEGTLEAIRLCARQEGMLTDPVYEGKSMHGMIDKVKRGEFPAGSRVLYAHLGGVPALNAYSFLFRNG

SEQ ID NO: 178 - DNA, 909 bp, Cytophaga hutchinsonii
  CDS (1)..(909)
atgcatcaaagtccacttcaacctatcattttaccacaaacagaaaaggctggtgtacaattgtatctgaagcgcgacgatctcattcatcccttatatggcggtaataagatccggaagttaaagtacaatgtgcagcaatgtttgcgtgaaggtaaaataggtttgctcacctgcggcggcgcctactccaaccacattattgcaacggcagcgtatggaaaagagcatggtttgaaaaccaaggcaatcattcgcggagaagagctgctgattgataaccctacgcttaaagatgcggcagcacttgggatggaatttgtttttgtttcaagagaaacataccgaagcattcgtgaacaaaatgcgttggcttttgatttaagtaaatcgaattataacgaatggtattttattcccgaaggcggcaccaatgcttttgctgttgaaggtattgcagaactggtagctgaaattgaaatcccgtttgattatatcgctacaccctgcggtacgggtggtacttttgccggtttgatgaaaggcattaaagtttattcgccgtggcgaacgaaactgcttgttttttcggcgttgaaaaacggtaattatattattgatgaagtggctgaattgctgaaagcagattttgacagaacaacgttagagttgtttacttcagagtacgtgtttggcggctatggaaaggtgaaacctgaactgattgcttttgtaaaatcgtttgagcatcagacaggaattttattagatcctatttataacgggaaaatgatgtttggtctgttgggtaaaattgaaagtggctattttaaaaagggttcagtgattgttgctattcacactggaggaatccaagcctggagagggtttaacaataattttacttaa

SEQ ID NO: 179 - protein, 302 aa, Cytophaga hutchinsonii
MHQSPLQPIILPQTEKAGVQLYLKRDDLIHPLYGGNKIRKLKYNVQQCLREGKIGLLTCGGAYSNHIIATAAYGKEHGLKTKAIIRGEELLIDNPTLKDAAALGMEFVFVSRETYRSIREQNALAFDLSKSNYNEWYFIPEGGTNAFAVEGIAELVAEIEIPFDYIATPCGTGGTFAGLMKGIKVYSPWRTKLLVFSALKNGNYIIDEVAELLKADFDRTTLELFTSEYVFGGYGKVKPELIAFVKSFEHQTGILLDPIYNGKMMFGLLGKIESGYFKKGSVIVAIHTGGIQAWRGFNNNFT

SEQ ID NO: 180 - DNA, 1026 bp, Brevibacterium linens
  Brevibacterium linens BL2
  CDS (1)..(1026)
atggtcgacctgaacacactgccccgccgccgctacaccaaggggcccaccccgcttgagcacctcggagccttgagtgcgaagctgggcgggccgcagatctggatcaaacgcgatgaccaactgggcctgacccagggtgggaataagacccgcaaactcgagttcctcatcgccgatgctctggtacagggggctgacactctcgtcaccgcaggcggcgtgcagtccaatcactgccggctcacactctcggcggctcggcgtgaaggactcgactgccacctcgtgctcgaggaggacctcggccccgatggcaagccggtcccagcggaagccggtggcaatcctgccgagcacacgggcaatttcctgctcttcgacctcctcggcgcggattcggttgaggtccaccccaatggcagcgagctcatcgcccgcgccgacgagctcgctgccgaactcaagggacaggggaagagcccctacgtcatccccgtcggcggctcgaatatcaccggggctctggggtatgtcgattgcgcgcaagaactgctcacccagttcgccgaggttgggctggacgtctcgtcgctcgtcaccccgagcgggtctgccgggatgcaggccggactcatcgctggtctccacgccgcgggcagtcagatcccggtcgtcgggatcaacgtcagccgcacacaggaggaccaggaacaaaagatcgtgagcctcgttgatgaggtggcatcgttcctcgagctgccgccggtcccccgcgatcgcagtgtcggcctgggcggctacttcggcaccggctatgcactgcccacacccggaatggccgaggcggtgcgtctcttcgccgagaccgagggcatcctgctcgatcccgtctatacggggaaggccgcggccgggctcatcgatctggtccgccaggggcggttcgagcccgacgacaacgtggtcttcatccattcgggtggagtgcccggactctatgctcgcgccggagcattcgcatag

SEQ ID NO: 181 - protein, 341 aa, Brevibacterium linens
  Brevibacterium linens BL2
MVDLNTLPRRRYTKGPTPLEHLGALSAKLGGPQIWIKRDDQLGLTQGGNKTRKLEFLIADALVQGADTLVTAGGVQSNHCRLTLSAARREGLDCHLVLEEDLGPDGKPVPAEAGGNPAEHTGNFLLFDLLGADSVEVHPNGSELIARADELAAELKGQGKSPYVIPVGGSNITGALGYVDCAQELLTQFAEVGLDVSSLVTPSGSAGMQAGLIAGLHAAGSQIPVVGINVSRTQEDQEQKIVSLVDEVASFLELPPVPRDRSVGLGGYFGTGYALPTPGMAEAVRLFAETEGILLDPVYTGKAAAGLIDLVRQGRFEPDDNVVFIHSGGVPGLYARAGAFA

SEQ ID NO: 182 - DNA, 1017 bp, Brevibacterium linens
  Brevibacterium linens BL2
  CDS (1)..(1017)
atggcaatcaccgatttcgaacgttacccattgaccttcaggcccagcccggtccacgagctgaagcgactcagtgaccgcctcggcggggcccgggtatgggccaagcgcgaagacgtgaactccggactcgcgttcggcggcaacaagacccgcaagctcgaatacatcgttcccgacatcctcgcctctgacgcggacacgctcgtctcgatcggcggctaccagtcgaaccacacgcggcaggtcgcggccgtcgcggcacacctgggactgaagtcgcggctcgtccaggaacgctgggtcgactgggacgatccggtcaacgacaaagtcggcaacatcgaactctcccgcatcatgggcgccgatgtgcacctcgactccgctggattcgacatcggcatccgctcgagctgggagaacgccatcgccgaggtggaggccgcaggtggcaggccctaccccattccggccggtgcctcggagcacaaattcggtgcactcggcttcgtcaactgggcctacgaggtcgcagaacaggagagggagctcggcgtcttcttcgacacgatcatcgtctgcacggtcaccggctccactcacgcgggaatgatcgcaggcttcgccgcgctcgaggcggccggaggtcccaagcgccaggtcatcggcatcgacgcctctgcgaccctggacaagacccgtgaccaggtcaaacgcatcgcgaacaatgccgctgacctcatcggcctcggtcgggagatcaccgatgctgacgtcgacatccgctccggctgggaaggccctgcctacggcgtccccgacgagacgaccgtcaacgcgatccgcaccaccgccgaactcgaaggcgtcatcctcgaccccgtctacgagggcaagtcgatggcggggctgctcgacctcgtcggaagcggcacggtggcgaaggattcgacggtcctctacgcccacctcggcggacagctggcgctcaacgcctacagctccatcttctga

SEQ ID NO: 183 - protein, 338 aa, Brevibacterium linens
  Brevibacterium linens BL2
MAITDFERYPLTFRPSPVHELKRLSDRLGGARVWAKREDVNSGLAFGGNKTRKLEYIVPDILASDADTLVSIGGYQSNHTRQVAAVAAHLGLKSRLVQERWVDWDDPVNDKVGNIELSRIMGADVHLDSAGFDIGIRSSWENAIAEVEAAGGRPYPIPAGASEHKFGALGFVNWAYEVAEQERELGVFFDTIIVCTVTGSTHAGMIAGFAALEAAGGPKRQVIGIDASATLDKTRDQVKRIANNAADLIGLGREITDADVDIRSGWEGPAYGVPDETTVNAIRTTAELEGVILDPVYEGKSMAGLLDLVGSGTVAKDSTVLYAHLGGQLALNAYSSIF

SEQ ID NO: 184 - DNA, 1017 bp, Burkholderia vietnamiensis
  Burkholderia vietnamiensis G4
  CDS (1)..(1017): transl_table=11
atgaacctgcaacgttttccccgctacccgctcacgttcggcccgacgccgatccagccgctcaagcgcctgagcgcgcacctcggcggcaaggtcgagctgtatgcgaagcgcgaggactgcaacagcggtctcgcgttcggcggcaacaagacgcgcaagctcgaatacctgatccccgatgcactcgcacaaggcgccgacacgctcgtgtcgatcggcggcgtgcagtcgaatcaaacgcgccaggtcgcggccgtcgccgcgcatctcgggatgaagtgcgtgctcgtgcaggagcactgggtcaactacgacgatccggtctacgatcgcgtcggcaacatccagttgtcgcgcatgatgggcgccgacgtgcggctcgtcgccgacggcttcgacatcggcattcgccgcagctgggaagatgcgatggaaagcgtccggcaggccggcggcaagccctatccgattccggccggctgctccgagcatccgctcggcgggctcggcttcgtcggcttcgcagaggaggtgcgcgaacaggaggcgcagctcggcttccggttcgattacgtcgtggtgtgctcggtgaccggcagcacgcaggcggggatggtggtcggcttcgcggccgacggacgcgcggatcgcgtgatcggcatcgacgcatcggcaacgcccgagcgcacgcgcgagcagatcacccgcatcgcgcggcatacggccgaactggtcgaactcggccggccgatcgcagacgcggacgtcgtgctcgacacgcgctacgcgggccccgagtacgggttgccgaacgacggcacgctggaggcgatccggctgtgcgcgcgtctggaaggcgtgttgacggaccccgtctacgaaggcaaatcgatgcacgggatgatcgacatggtgcgtcgcggggaattcgagccgggatcgaaggtgctgtatgcgcatctcggcggagtgcctgcgctgagcgcctacgcggagatctttcgcgacggctga

SEQ ID NO: 185 - protein, 338 aa, Burkholderia vietnamiensis
  Burkholderia vietnamiensis G4
MNLQRFPRYPLTFGPTPIQPLKRLSAHLGGKVELYAKREDCNSGLAFGGNKTRKLEYLIPDALAQGADTLVSIGGVQSNQTRQVAAVAAHLGMKCVLVQEHWVNYDDPVYDRVGNIQLSRMMGADVRLVADGFDIGIRRSWEDAMESVRQAGGKPYPIPAGCSEHPLGGLGFVGFAEEVREQEAQLGFRFDYVVVCSVTGSTQAGMVVGFAADGRADRVIGIDASATPERTREQITRIARHTAELVELGRPIADADVVLDTRYAGPEYGLPNDGTLEAIRLCARLEGVLTDPVYEGKSMHGMIDMVRRGEFEPGSKVLYAHLGGVPALSAYAEIFRDG

SEQ ID NO: 186 - DNA, 1017 bp, Burkholderia cenocepacia
  Burkholderia cenocepacia AU 1054
  CDS (1)..(1017): transl_table=11
atgaatctgcaacgcttcccccgttatccgctgacgttcggcccgacgcccatccagccgctcaagcgcctgagcgcgcatctcggcggcaaggtcgacctgtatgcgaagcgcgaggactgcaacagcggcctcgcattcggcggcaacaagacgcgcaagctcgaatatctcgttcccgacgcgctcgcgcagggcgccgacacgctcgtgtcgatcggcggcgtgcagtcgaaccagacccgccaggtcgcggccgtcgccgcgcatctcggaatgaaatgcgtgctcgtgcaggagcactgggtcaactatgaagatccggtgtacgaccgggtcggcaacatccagttgtcgcggatgatgggcgccgacgtgcggctcgtctccgacggtttcgacatcggcattcgccgcagttgggaagaagcgatggagagcgtgcgacaggcggggggcaagccgtatccgattccggccggctgctccgagcatccgctcggcgggctcgggttcgtcggcttcgcggaagaagtgcgggcgcaggaagcgcagctcggcttcaagttcgactacgtcgtcgtctgctcggtgacgggcagcacgcaggcgggaatggtcgtgggcttcgcggccgacggacgcgcggaccgcgtgatcggcatcgacgcatcggcgaagccggaacagacacgcgaacagatcacgcgcatcgcgcggcatacggccgagctggtcgagctgggccgcgatatcgtcgaacaggacgtcgtgctcgacacgcgttacggcggacccgaatatggtctgccgagcgacggcacgctggaagcgattcggctgtgcgcacggctggaaggcatgctgaccgatcccgtttatgaagggaaatcgatgcacgggatgatcgacaaggtgcggctcggggaattcgagccggggtcgaaggtgctgtatgcgcatctcggcggggcgccggcgttgagtgcgtataacgggatttttcgcaacgggtga

SEQ ID NO: 187 - protein, 338 aa, Burkholderia cenocepacia
  Burkholderia cenocepacia AU 1054
MNLQRFPRYPLTFGPTPIQPLKRLSAHLGGKVDLYAKREDCNSGLAFGGNKTRKLEYLVPDALAQGADTLVSIGGVQSNQTRQVAAVAAHLGMKCVLVQEHWVNYEDPVYDRVGNIQLSRMMGADVRLVSDGFDIGIRRSWEEAMESVRQAGGKPYPIPAGCSEHPLGGLGFVGFAEEVRAQEAQLGFKFDYVVVCSVTGSTQAGMVVGFAADGRADRVIGIDASAKPEQTREQITRIARHTAELVELGRDIVEQDVVLDTRYGGPEYGLPSDGTLEAIRLCARLEGMLTDPVYEGKSMHGMIDKVRLGEFEPGSKVLYAHLGGAPALSAYNGIFRNG

SEQ ID NO: 188 - DNA, 969 bp, Kineococcus radiotolerans
  Kineococcus radiotolerans SRS30216
  CDS (1)..(969): transl_table=11
gtggcaccgcgagacgaccgcaccgtcctgggcacctggccgacgccggtggaggccgcgccccgcctggccgcggcgatcggcctcggacccggcgacctgctggtcaagcgcgacgacctcgtcggcctggccggcgggggcaacgaggtccgcgagctggagcgcaccctcggcgcggccctggcggagggggcgcggacggtggtcaccagcggcgcgccgcagagcaaccacgcccgcctcaccgccgccgccggtgcgcgcctcggcctggacgtcgtgctcgtgctggaggggtcgccccccgcggccccgggcgggaacctgctgctcgacgcgctgctgggcgcccggatcgtctgggccggcgacgtcagccccggcgagctggcggcccgggtcgaggcggaggccgaggacctgcgggccggcgacggcgcgggtggggtcgcggtcgtgcccttcggcggttccagcgtgctcggggcccgcggctacgtcgacgcgggggccgagctgctggagcaggtccccgacctcgacgtggtcgtggtcgccgtcggttccggggggaccatggccgggctcgtgcacgccctcggcgcgcaccgcgtcctcggggtcgacaccggcgcggtggacgaccccgagcagcgggtgcgcgggttcgccgccggtctggccgcgcaggacgggacccccgcgcccggggccctgcggttgcgccgcgacgaggtcggcgccggctacggcgtgctcaccgcgcgggtgcggcaggcgctgacgctggtcgcgcgcaccgaggggatcgtcctggaccccgtctacaccggccgcgccgccgcggggctgctgaccgcggtggagcagggcgagatccgtcccgggcagcgcacggtcctgctgcacagcggcgggctgccggggttgttcggccaccccgacgccgcgagcctcacgggctga

SEQ ID NO: 189 - protein, 322 aa, Kineococcus radiotolerans
  Kineococcus radiotolerans SRS30216
MAPRDDRTVLGTWPTPVEAAPRLAAAIGLGPGDLLVKRDDLVGLAGGGNEVRELERTLGAALAEGARTVVTSGAPQSNHARLTAAAGARLGLDVVLVLEGSPPAAPGGNLLLDALLGARIVWAGDVSPGELAARVEAEAEDLRAGDGAGGVAVVPFGGSSVLGARGYVDAGAELLEQVPDLDVVVVAVGSGGTMAGLVHALGAHRVLGVDTGAVDDPEQRVRGFAAGLAAQDGTPAPGALRLRRDEVGAGYGVLTARVRQALTLVARTEGIVLDPVYTGRAAAGLLTAVEQGEIRPGQRTVLLHSGGLPGLFGHPDAASLTG

SEQ ID NO: 190 - DNA, 969 bp, Nocardioides
  Nocardioides sp. JS614
  CDS (1)..(969): transl_table=11
atgaaccttcccgatctcccacgtctccccctggtactcgcgccgacgccgctcgtaccagccccgcggctatccgaaattctcggactcgacgtgtggttcaagcgggacgatctcactggtcgaggccttggcgggaacaaggttcgtcccctcgagtacctgctcggcgatgcaaagaccaagggctgcgacgccctcgtgacaggcgccggaccgcagtccaactgggcaatgctggcagccctgaccgcgcacggagcgggcatcgccccccacctcgtcttctacggtgacccacagcacccgacaggtaacctgctgctcgcccagctcgccggcgcagacatccactacaccggcgaactcgatcgcggatctgtcgacccggcgctgttcaaggccgccgacgaactcaccgatgcaggccacctgccttacgtggtaccgcgaggcggggcgacgcccatcgggtgcctcggctatgtccgcgccacagcggaactgcttgcccagctggccgaaacgggcctttctccagcgtccatatggctggccacagggtccggcggcacccaagctggactcgtcgccggagcccagtggtccggctgggagatcgatgtcatcgggatcacgacgagccgatctcccgaggaggcggcgtcccgggtgcgagacctggcctcagcgacgctcgacttgatcggagtcggcgacacctccattgcagcaccccaggtgcgcggagggtatctcggtgagggctatggcaaggcctccccggcgggagctgctgcagcccagctcgtcgctcagaccgaaggcgtcttcctcgacccagccttcggagcaaaagcgatggcagccctgatcgatgcagcccgtgatggcaccgttgagggtccggtggtgttcctcgtcaccggaggggccccgaccctcttcactcccggagctcaactgtga

SEQ ID NO: 191 - protein, 322 aa, Nocardioides
  Nocardioides sp. JS614
MNLPDLPRLPLVLAPTPLVPAPRLSEILGLDVWFKRDDLTGRGLGGNKVRPLEYLLGDAKTKGCDALVTGAGPQSNWAMLAALTAHGAGIAPHLVFYGDPQHPTGNLLLAQLAGADIHYTGELDRGSVDPALFKAADELTDAGHLPYVVPRGGATPIGCLGYVRATAELLAQLAETGLSPASIWLATGSGGTQAGLVAGAQWSGWEIDVIGITTSRSPEEAASRVRDLASATLDLIGVGDTSIAAPQVRGGYLGEGYGKASPAGAAAAQLVAQTEGVFLDPAFGAKAMAALIDAARDGTVEGPVVFLVTGGAPTLFTPGAQL

SEQ ID NO: 192 - DNA, 969 bp, Nocardioides
  Nocardioides sp. JS614
  CDS (1)..(969): transl_table=11
atgaacctgccggacctgccccgtctgcacctggtgctggcgccgacgccgctcgtccacgcgccccgcctgtccgaggccgtcggtgttgaggtgtggttcaagcgagacgacctgaccggccgaggcctcggtggcaacaaagtccgcaccctggagtacctcctcggggacgctgtggccaagggatgcgacgcactggtgaccggggccggcccgcagtccaactgggcgatgctcgcggcactgtccgcccgcaccgccgggttctcgccgcaccttgtcttctatggtgacccacctgaggcgagcggcaacctgttgctcacccaggtgacgtgtacagacatccgctacaccggtgagctcgaccgctgctctgtcgactccatgctgggcaaggtcgccgacgagctcgtcgcggccggtcgctttccctatgtcgtgccgagaggcggggccaccccgttggggtgcctgggctatctccgggccgctgtggagctcgtgcggcaactgccggaggtgggtgtcgaccccgcaacgctctgggtgccgaccggatccggcggcacccaggcaggacttctcgccggggcgcactggttgggatgggacgttgcggtggtcggggtcgccaccagccggactcctgaagaggcccaggtccgcgttggcgagctcgcctcggccactctcgagctgctcgacgccgatgacacggctcgagcagcgccgcacgtcctcggcgggttcctcggcgacggctatggcgaagtctcgccagcgggtaccgcggcggccgagctcgtcgcgcggaccgagggcatcttcctcgacccggtgttcggcgccaaggcgatggcggctctcttggctgaagtccggcatggaaccgtccgagggccggtgatcttcctggtcaccggaggcgcacccaccctcttcatgaagggcacggaactgtga

SEQ ID NO: 193 - protein, 322 aa, Nocardioides sp.
  Nocardioides sp. JS614
MNLPDLPRLHLVLAPTPLVHAPRLSEAVGVEVWFKRDDLTGRGLGGNKVRTLEYLLGDAVAKGCDALVTGAGPQSNWAMLAALSARTAGFSPHLVFYGDPPEASGNLLLTQVTCTDIRYTGELDRCSVDSMLGKVADELVAAGRFPYVVPRGGATPLGCLGYLRAAVELVRQLPEVGVDPATLWVPTGSGGTQAGLLAGAHWLGWDVAVVGVATSRTPEEAQVRVGELASATLELLDADDTARAAPHVLGGFLGDGYGEVSPAGTAAAELVARTEGIFLDPVFGAKAMAALLAEVRHGTVRGPVIFLVTGGAPTLFMKGTEL

SEQ ID NO: 194 - DNA, 999 bp, Syntrophobacter fumaroxidans
  Syntrophobacter fumaroxidans MPOB
  CDS (1)..(999): transl_table=11
atgagcatcggaatcgacgagatgcccagaattgaaatcggtttcttcccgacgccgctggtcgaagtcaggagacttgccgctgttctcggagggccgcgccttttcatgaaacgcgacgacctgaccgggctggcgctgggcggcaacaagaccaggaagctcgaattcctgctgggagatgccttgagccgaggttgcgatacagtgatcacaggcggcgccgctcaatccaatcactgccggcagacggcggccgcggccgccgcggtcggcctggaatgccatctcgcgcttggcggcgaagagccgccgctggtgaacggaaacctgctcctcgaccgtctgttcggcgccgtcgttcattggtgcggagaacagcgcaaaggcgaacgcattccggaaatcgcggcagggctgcgtgcactcgggcgcagggtctatatcatcccttacggggggtccgatgcggtcggcgcgatgggcttcgtggcagccgtccgcgagctcaaacagcaacttgcctcgcggaacgaaaagatcgacaccgtgatcattccgtcgagttccggcgggacccacgcgggtctcaccgtgggaatcgatgcgttcgattttccggcacaggtgatcggcatcgggatcgacaaaggggtgtcgggcgggggttcatacgaatccgaactggcggtcctggccaaccggattgccgggacgctcgggctgcaggcgaactacgacgccgaccggttccggatgcgctatgaatacctgggtgccggatacggggtggtgggcgacctcgagcgcgaggcgatccgcctgctggcgcgatgcgaagggatcctggccgatccggtctacacggggagagcgctgggcggcatgatcgacatgatccgcgggaaggaattcgcgcccggcgatacggtgctgttctggcacacggggggcgtgccggcgctcttcgagtatgcgggcgagctccatgccgggtga

SEQ ID NO: 195 - protein, 332 aa, Syntrophobacter fumaroxidans
  Syntrophobacter fumaroxidans MPOB
MSIGIDEMPRIEIGFFPTPLVEVRRLAAVLGGPRLFMKRDDLTGLALGGNKTRKLEFLLGDALSRGCDTVITGGAAQSNHCRQTAAAAAAVGLECHLALGGEEPPLVNGNLLLDRLFGAVVHWCGEQRKGERIPEIAAGLRALGRRVYIIPYGGSDAVGAMGFVAAVRELKQQLASRNEKIDTVIIPSSSGGTHAGLTVGIDAFDFPAQVIGIGIDKGVSGGGSYESELAVLANRIAGTLGLQANYDADRFRMRYEYLGAGYGVVGDLEREAIRLLARCEGILADPVYTGRALGGMIDMIRGKEFAPGDTVLFWHTGGVPALFEYAGELHAG

SEQ ID NO: 196 - DNA, 1017 bp, Burkholderia ambifaria
  Burkholderia ambifaria AMMD
  CDS (1)..(1017): transl_table=11
atgaacctgcaacgtttctcccgttatccgctcacgttcggcccgacgccgatccagccgctcaagcgcctgagccagcacctcggcggcaaggtcgagctgtatgcgaagcgcgaggactgcaacagcggcctcgcgttcggcggcaacaagacacgcaagctcgaatacctcgtcccggatgcgctcgcacagggcgcggatacgctcgtgtcgatcggcggcgtgcagtcgaaccagacgcgccaggtcgcggccgtcgccgcgcatctcgggatgaagtgcgtgctcgtgcaggaacactgggtgaactacgaagaccccgtgtacgaccgcgtcggcaacatccagctgtcgcgcatgatgggcgccgacgtgcggctcgttgccgacggcttcgacatcggcattcgccgcagctgggaagaagcgatggagagcgtgcggcaggcgggcggcaagccgtatccgattccggccgggtgttccgagcatccgctcggcggtctcggcttcgtcggcttcgcggaagaagtgcgcgagcaggaagcacagctcgggttcaagttcgactatgtcgtggtctgctcggtgacgggcagcactcaggcggggatggtcgtcggcttcgcggccgacggacgcgcggatcgcgtgatcggcatcgacgcgtcggcgacgcccgagcgcacgcacgaacagatcacgcgcattgcgcggcatacggccgaactggtcgatctcggccggccgatcaccgaggcggacgtcgtgctcgacacgcgctatgccggcccggaatacggattgccgaacgatggcacgctggaggcgattcgcttgtgtgcacggctcgaggggatgctgaccgatcccgtctacgaagggaaatcgatgcacgggatgatcgacaaggtgcgtcgcggggaattcgagccggggtcgaaggtgctgtatgcgcatctcggcggggtgccggcgctgagcgcgtacgcggagatcttccgcaacgggtga

SEQ ID NO: 197 - protein, 338 aa, Burkholderia ambifaria
  Burkholderia ambifaria AMMD
MNLQRFSRYPLTFGPTPIQPLKRLSQHLGGKVELYAKREDCNSGLAFGGNKTRKLEYLVPDALAQGADTLVSIGGVQSNQTRQVAAVAAHLGMKCVLVQEHWVNYEDPVYDRVGNIQLSRMMGADVRLVADGFDIGIRRSWEEAMESVRQAGGKPYPIPAGCSEHPLGGLGFVGFAEEVREQEAQLGFKFDYVVVCSVTGSTQAGMVVGFAADGRADRVIGIDASATPERTHEQITRIARHTAELVDLGRPITEADVVLDTRYAGPEYGLPNDGTLEAIRLCARLEGMLTDPVYEGKSMHGMIDKVRRGEFEPGSKVLYAHLGGVPALSAYAEIFRNG

SEQ ID NO: 198 - DNA, 987 bp, Shigella boydii
  Shigella boydii BS512
  CDS (1)..(987)
atgccactgcataatttaacccgttttccacggctggagtttatcggcgcgccaacgccgctcgaatatctgccgcgcttttctgattatcttggacgggaaattttcatcaaacgggatgacgtcacacccatggcaatgggcggcaataaattacgtaagctggaatttctcgcggcagatgccctgcgcgaaggtgccgatacgctgattactgccggcgcgatccagtctaaccatgtgcggcagactgccgcagttgcggcgaaactcggcctgcactgcgtggcgctgctggaaaatcctattggcacaaccgcagaaaactatttaaccaacggcaatcgtttgttgctgaatctgttcaatacccagattgaaatgtgcgacgcactgaccgatcccaatgcccaactggaagagctggcgacgcgagtcgaagcacaaggctttcgcccgtatgtcattccggttggcggttctaatgctctgggcgcgctgggttatgtggagagtgcgctggaaatcgcgcaacagtgtgaaggggcggttaatatttcgtcggtggtggtcgcatcgggcagtgccggaactcacgccggattggctgttgggctggaacacctgatgcctgaaagcgaactgattggcgtgaccgtgtcgcgttccgttgccgatcaattgccgaaagtggttaacctacaacaggcgattgcgaaagaactggagctgaccgcatcagcggaaattttactctgggatgactattttgcacctggctacggcgtgccgaacgacgaaggcatggaagcagtgaaattgctggcgcgtctggaaggcattctgcttgatcctgtgtataccggaaaagcgatggcggggctgattgacggtatcagtcagaaacgcttcaaagatgaagggccgattctgtttattcataccggcggcgcgcctgcgctgttcgcctatcatccccacgtttag

SEQ ID NO: 199 - protein, 328 aa, Shigella boydii
  Shigella boydii BS512
MPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLNLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTGGAPALFAYHPHV

SEQ ID NO: 200 - DNA, 1029 bp, Escherichia coli
  Escherichia coli E24377A
  CDS (1)..(1029)
atgccactgcataatttaacccgttttccacggttggagtttatcggcgcgccaacgccgctcgaatatctgccgcgcttttctgattatcttggacgggaaattttcatcaaacgggatgacgtcacccccatggcaatgggcggcaataaattacgtaagctggaatttctcgcagcagatgctctgcgcgaaggtgccgatacgctgattactgccggcgcgatccagtctaaccatgtgcgccagactgccgcagttgcggcgaaactcggtctgcactgcgtggcgctgctggaaaatcctattggcacaaccgcagaaaactatttaaccaacggcaatcgcttgttgctggatctgttcaatacccagattgaaatgtgcgacgcactgaccgatcccaatgcccaactggaagagctggcgacgcgagtcgaagcacaaggctttcgcccgtatgtcattccggttggcggttctaatgctctgggcgcgctgggttatgtggagagtgcgctggaaatcgcgcaacagtgtgaaggggcggttaatatttcgtcggtggtggtcgcatcgggcagtgccggaactcacgccggattggctgttgggctggaacacctgatgcctgaaagcgaactgattggcgtgaccgtgtcgcgttccgttgccgatcaattgccgaaagtggttaacctacaacaggcgattgcgaaagaactggagctgaccgcatcagcggaaattttactctgggatgactattttgcacctggctacggcgtgccgaacgacgaaggcatggaagcagtgaaattgctggcgcgtctggaaggcattctgcttgatcctgtgtataccggaaaagcgatggcggggctgattgacggtatcagtcagaaacgcttcaaagatgaagggccgattctgtttattcataccggcggcgcgcctgcgctgttcgcctatcatcccacgtttagctccgggaacgctcatgcaagaaagtatacaactggttattga

SEQ ID NO: 201 - protein, 342 aa, Escherichia coli
  Escherichia coli E24377A
MPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTGGAPALFAYHPTFSSGNAHARKYTTGY

SEQ ID NO: 202 - DNA, 987 bp, Escherichia coli
  Escherichia coli HS
  CDS (1)..(987)
atgccactgcataatttaacccgttttccacggttggagtttatcggcgcgccaacgccgctcgaatatctgccgcgcttttctgattatcttggacgggaaattttcatcaaacgggatgacgtcacccccatggcaatgggcggcaataaattacgtaagctggaatttctcgcagcagatgctctgcgcgaaggtgccgatacgctgattactgccggcgcgatccagtctaaccatgtgcgccagactgccgcagttgcggcgaaactcggtctgcactgcgtggcgctgctggaaaatcctattggcacaaccgcagaaaactatttaaccaacggcaatcgcttgttgctggatctgttcaatacccagattgaaatgtgcgacgcactgaccgatcccaatgcccaactggaagagctggcgacgcgagtcgaagcacaaggctttcgcccgtatgtcattccggttggcggttctaatgctttgggcgcgctgggttatgtggagagtgcgctggaaatcgcgcaacagtgtgaaggggcggttaatatttcgtcggtggtagtcgcatcgggcagtgccggaactcacgccggactggctgttgggctggaacacctgctgcctgaaagcgaactgattggcgtgaccgtgtcgcgttccgttgccgatcaattgccgaaagtggttaacctacaacaggcgattgcgaaagaactggagctgaccgcatcagcggaaattttactctgggatgactattttgcacctggctacggcgtgccgaacgacgaaggcatggaagcagtgaaattgctggcgcggtttgaaggcattctgcttgatcctgtgtataccggaaaagcgatggcgggtctgattgacggtatcagtcagaaacgcttcaaagatgaagggccgattctgtttattcataccggcggcgcgcctgcgctgttcgcctatcatccccacgtttag

SEQ ID NO: 203 - protein, 328 aa, Escherichia coli
  Escherichia coli HS
MPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLLPESELIGVTVSRSVADQLPKVVNLQQAIAKELELTASAEILLWDDYFAPGYGVPNDEGMEAVKLLARFEGILLDPVYTGKAMAGLIDGISQKRFKDEGPILFIHTGGAPALFAYHPHV

SEQ ID NO: 204 - DNA, 987 bp, Escherichia coli
  Escherichia coli B7A
  CDS (1)..(987)
atgccactgcataatttaacccgttttccacggttggagtttatcggcgcgccaacgccgctcgaatatctgccgcgcttttctgattatcttggacgggaaattttcatcaaacgggatgacgtcacacccatggcaatgggcggcaataaattacgtaagctggaatttctcgcggcagatgccctgcgcgaaggtgccgatacgctgattactgccggcgcgatccagtctaaccatgtgcgccagactgccgcagtcgcggcgaaactcggtctgcactgcgtggcgctgctggaaaatcctattggcacaaccgcagaaaactatttaaccaacggcaatcgtttgttgctggatctgttcaatacccagattgaaatgtgcgatgcactgaccgatcccaatgcccaactggaagagctggcgacgcgagtcgaagcacaaggctttcgcccgtatgtcattccggttggcggttctaatgctcttggcgcgctaggttatgtggagagtgcgctggaaatcgcgcaacagtgtgaaggggcggttaatatttcgtcggtggtagtcgcatcgggcagtgccggaactcacgccggactggctgttgggctggaacacctgatgcctgaaagcgaactgattggcgtgaccgtgtcgcgttccgttgccgatcaattgccgaaagtggttaacctacaacaggcgattgcgaaagaactggagctgaccgcatcagcggaaatttttctctgggatgactattttgcacctggctacggcgtgccgaacgacgaaggcatggaagcagtgaaattgctggcgcggctggaaggcattctgcttgatcctgtgtataccggaaaagcgatggcggggctgattggcggtatcagtcagaaacgcttcaaagatgaagggccgattctgtttattcataccggcggtgcgcctgcgctgttcgcctatcatccccacgtttag

SEQ ID NO: 205 - protein, 328 aa, Escherichia coli
  Escherichia coli B7A
MPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEIFLWDDYFAPGYGVPNDEGMEAVKLLARLEGILLDPVYTGKAMAGLIGGISQKRFKDEGPILFIHTGGAPALFAYHPHV

SEQ ID NO: 206 - DNA, 957 bp, Pseudoalteromonas atlantica
  Pseudoalteromonas atlantica T6c
  CDS (1)..(957): transl_table=11
gtgaacgacaccttaaacttaacgcctattcttcaggacatttccctcccctcccctgcgcagcagatattcccggattgggagcatgctgatgaagtacaattatgggtaaaacgcgacgatctaattcaccccatagtatcagggaataaatggcgtaaattacgttacacacttgagcgagctgttggcactggggttcggcacatcgtcagcttcggcggtgcgcattcgaatcatctacatgcactgggttatgcttgcaatagcctaaatataaagctaacagcgatagtacgtggtcactttcataataatccgacacctatgctacaagatttagtggcatggcaagctgacgtgcaatttgctgatcgtaagacatatcaactgcgcaatgacgaaacttacttggcctcattagctcagcaatatcctaatgctatgtttatcccagaaggcggctcttctgagttcgctctcgctggcgtggcggacattgttcgtgagctcactcaacgttatgactacttgttaacgcctgttggcagcggggggacattagccgggcttattcatggtgcgatgagtcaacctgtgccattacacaccaaaatcatcggaatcgctgtgcttagaggtgaggggtatctcgaagagttggtgagtaacttactgtcatcccgggctatgttgccatcgcaagctaacacacgtgaacctatcgctgattggcacattaaccaccagtttcattttaatggctacgcgaaggctacacctgaactgcatcaattttgtcagtcgttcaatgagacactgagcattcctattgagcctgtgtatagcggcaagcttttttgggcggtaaaagaactcatggctaaaaaggcgtttacacccggcagcaaaattttgctattgcatacaggtggactacaaggcgctagaggctaa

SEQ ID NO: 207 - protein, 318 aa, Pseudoalteromonas atlantica
  Pseudoalteromonas atlantica T6c
MNDTLNLTPILQDISLPSPAQQIFPDWEHADEVQLWVKRDDLIHPIVSGNKWRKLRYTLERAVGTGVRHIVSFGGAHSNHLHALGYACNSLNIKLTAIVRGHFHNNPTPMLQDLVAWQADVQFADRKTYQLRNDETYLASLAQQYPNAMFIPEGGSSEFALAGVADIVRELTQRYDYLLTPVGSGGTLAGLIHGAMSQPVPLHTKIIGIAVLRGEGYLEELVSNLLSSRAMLPSQANTREPIADWHINHQFHFNGYAKATPELHQFCQSFNETLSIPIEPVYSGKLFWAVKELMAKKAFTPGSKILLLHTGGLQGARG

SEQ ID NO: 208 - DNA, 993 bp, Pseudoalteromonas atlantica
  Pseudoalteromonas atlantica T6c
  CDS (1)..(993): transl_table=11
atgataaactttgcacttattccacgggtaacaatctcccacaatccaacaccccttgagagtttacccaggttatctgaaaaagtgggatgcaaggtgtatatcaaacgcgatgattgcaccggacttgctggtggcggcaataaaacccgcaaactagagtatttaatcgccgatgctcagcaacacggggccgacactctggtgacggtgggaggcttgcaatcaaatcatgcgcggcaaactgctgccgcggccgctaaatttggcttaggttgcgagcttgtgctcgaagatgttaagggcacgcctaaagcggattattatcaaaacggaaatgtgttattggacactctactgggcgccaatatccatcgtttaggcctagaacaagaggttgaagcgtataccagtgcgctgcttgcaaagctaaaaattcaggggcgaaagccgtattttattcccatgggcgggtcgaatgtgatgggcagtttaggctatgtgcgctgcgccaaagaaatattacaacaattggcagatgatgatcttcacatcgaccaaattgtgctcgcgacgggcagtgcaggtacccaagcaggcttgcttgcagggctgattgctgctaactcagacatctcggtactgggggtagcggtgagtcgctcgaaggaagcgcaagaacagttagtggaacagttactcagagaaacgctcacttttttagacattgatcccaatcgggcgaaaggcaaagtggttgccaatggcaactattttggcgaaggttacggtatgactacgccatcaatggtaacggccgtcaagcgctgcgccgaactagaaggcgtgttattagatcccgtctatacgggcaaggcaatggctggctttatggacttgtgcgccacaggtgagattggggcaaatagtcaccagctatttattcatactgggggcagtcaggggctgtttgcttaccgtgaggaattttaa

SEQ ID NO: 209 - protein, 330 aa, Pseudoalteromonas atlantica
  Pseudoalteromonas atlantica T6c
MINFALIPRVTISHNPTPLESLPRLSEKVGCKVYIKRDDCTGLAGGGNKTRKLEYLIADAQQHGADTLVTVGGLQSNHARQTAAAAAKFGLGCELVLEDVKGTPKADYYQNGNVLLDTLLGANIHRLGLEQEVEAYTSALLAKLKIQGRKPYFIPMGGSNVMGSLGYVRCAKEILQQLADDDLHIDQIVLATGSAGTQAGLLAGLIAANSDISVLGVAVSRSKEAQEQLVEQLLRETLTFLDIDPNRAKGKVVANGNYFGEGYGMTTPSMVTAVKRCAELEGVLLDPVYTGKAMAGFMDLCATGEIGANSHQLFIHTGGSQGLFAYREEF

SEQ ID NO: 210 - DNA, 999 bp, Pseudoalteromonas atlantica
  Pseudoalteromonas atlantica T6c
  CDS (1)..(999): transl_table=11
atgcccttaagcgcccttaaaaaaatagaattgggcgttttccctacgcccattcataaattagcccgtttatcagctcatcttgttggcccgcagatttatatcaagcgagatgaccttaccggtttagcgcttgggggcaacaaaacccgtaaactcgaatacttattagctgatgggctagcccaaggctgtgattgtatcgttactgcaggtgcggctcagtcaaatcattgcaggcagactgccgcagcagccgctaccttgggggtagaatgccatttgatcttgggcgggcaggccccaattagcgcgaacggaaacctacttcttgaccagctatttggagcacgtattcattgggctggtcagaagcgcaaaggtgaagatattcctgatattgtcagcacgttgcaaaagcaaggaaagagaccttatgttgtaccgtatgggggctctaataccataggttcagccgggtttatcgacgccttcaaagagctacaacagcagtgtcacgctagtagtcaagtaattgaattttcagatattgtcttcgcgtctagctcgggagcaacccattgcggattagtgcttggaaaagcgctgtgtgatgccgccagtaatattattggaatcaatattgataaagatgagcaaggcaaagatagctttaaatctcagctgcaaacgctgatcgaggataccgctcgaacattctcgattaactacgatggtacagtggatgatgtacagttaatcgatgattatatcggccaaggatatggcgtggtgggcaatttagagcgtgaagcgatatctttgtgcgcccaacttgaagggatattgttagaccctgtatacactggacgggcgatgggcggtttaattgacatgatccgtcaaggtcgttttgcttcaaacagtaatgtgcttttttggcacactggtggggcgcctgctatctttgcatatgccgatgcattacaaccaagttga

SEQ ID NO: 211 - protein, 332 aa, Pseudoalteromonas atlantica
  Pseudoalteromonas atlantica T6c
MPLSALKKIELGVFPTPIHKLARLSAHLVGPQIYIKRDDLTGLALGGNKTRKLEYLLADGLAQGCDCIVTAGAAQSNHCRQTAAAAATLGVECHLILGGQAPISANGNLLLDQLFGARIHWAGQKRKGEDIPDIVSTLQKQGKRPYVVPYGGSNTIGSAGFIDAFKELQQQCHASSQVIEFSDIVFASSSGATHCGLVLGKALCDAASNIIGINIDKDEQGKDSFKSQLQTLIEDTARTFSINYDGTVDDVQLIDDYIGQGYGVVGNLEREAISLCAQLEGILLDPVYTGRAMGGLIDMIRQGRFASNSNVLFWHTGGAPAIFAYADALQPS

SEQ ID NO: 212 - DNA, 1020 bp, Yersinia pseudotuberculosis
  Yersinia pseudotuberculosis IP 31758
  CDS (1)..(1020)
atgattcatcaattccttggggggcacgtgacgcttcaacacaaactgacgcaattcccgcgtctcgatctggtcggtaatgcgacgccattagaaaagctgtctcgtctatctgattatctgggacgtgaaatttacattaaacgtgatgatgtcacgcctgtggcgcttggcgggaataaactgcgcaagctagaattcttagccgcagatgccttgagacagggagccgatacgctggttacggctggtgctattcaatctaatcatgtccgccaaaccgccgccgtggccgcgaaactggggctgcattgcgttgcgctgttggaaaaccccattggtactgagcaggcaaactatctgaccaatgggaaccggctgttactggacctattcaatgttgatgttgtgatgtgtgaggcattgaacgatccaaatcagcaattagcagaattggctacccgcgtggaagcgcagggtttccgcccatatgtggtaccgattggcggttctaatgccttgggcgcgctgggttatgtgcagtgctcactggaaattgctgctcaagccgcgggcaatgttgcgtttagttcggtcgtcgtggcctctggcagtgcgggaacacatgcaggattggcggttggtctacagcagttgttacccgatgcggaattaatcggtgtgacggtatcacgtagtgccgatgaacagcggcctaaagtggcacagattcaacaagcgttggcgacatcattagggatgacggacccattggcaaaaatcaccttgtgggatagttattttgccccgcaatatgggatgccaaacgaagaggggatagcggctattaagctcttggcaagactggaaggaatattgttggaccctgtgtataccggtaaggcgatggcgggcttacttgatggtattgaacagcaaaaattctgcgacaaagggccaattttatttatccacactggcggggcacctgcgctgtttgcttatcatccgcaggtgtag

SEQ ID NO: 213 - protein, 339 aa, Yersinia pseudotuberculosis IP 31758
  Yersinia pseudotuberculosis IP 31758
MIHQFLGGHVTLQHKLTQFPRLDLVGNATPLEKLSRLSDYLGREIYIKRDDVTPVALGGNKLRKLEFLAADALRQGADTLVTAGAIQSNHVRQTAAVAAKLGLHCVALLENPIGTEQANYLTNGNRLLLDLFNVDVVMCEALNDPNQQLAELATRVEAQGFRPYVVPIGGSNALGALGYVQCSLEIAAQAAGNVAFSSVVVASGSAGTHAGLAVGLQQLLPDAELIGVTVSRSADEQRPKVAQIQQALATSLGMTDPLAKITLWDSYFAPQYGMPNEEGIAAIKLLARLEGILLDPVYTGKAMAGLLDGIEQQKFCDKGPILFIHTGGAPALFAYHPQV

SEQ ID NO: 214 - DNA, 984 bp, Alkaliphilus metalliredigenes
  Alkaliphilus metalliredigenes QYMF
  CDS (1)..(984): transl_table=11
atgacaataccaaagtcacttaaattggcaaacctacctactaaaattgaaaagctggagagattgtctaaaagtctgggagacatcaatatttatatcaaaagagatgatcaaactgggacagaagtatcaggaaacaaggtgagaaagctggaatttgcagtacaagaggccttggaccaaggctgtgattatttaattacatgtggtgggattcaatcaaatcatgctagagccacggcggcggttgcagctaagctggacattaactcatacctagtgttgagaagcaatggggacgatcccgttgaagggaattattttctaaataagattcttggggcggaaatttgtctcattacccctgaagagtatagggataatcggatgaaggtgatggaagagatacaaagagagctagctggtcaaggacataaggcttatattttacccgaaggagcatctaatgggatcggtacatttggatactatcaagccatggaagaaattttagagcaagaagcggagttggatgtcaagttcgatgccatcgtcacagcagtaggatctgggggaacctacgcagggttattttacgctaataaactcagaaagaatgaggcgaaaatttatgggatcaatgtatgtgatgatgcagatcattttaaaaatagagtacaagaattagtccatgaaagcatacagtataccaaaagacccattcatttcaaaaaagaagacattcatatgattgatgggtatgtaggcgaaggatatgctcaaagtagacaagaagaactgacatttatccttgattttgcaaagctagagggtattattctggatcctgtttatacaggtaaggcaatgtatggtttagtggaagaaattaaaaagggaagttttaatggattcaaaaacattctctttatccataccggtggcctttacgggctgttccccaaggggaatcagttgttttaa

SEQ ID NO: 215 - protein, 327 aa, Alkaliphilus metalliredigenes
  Alkaliphilus metalliredigenes QYMF
MTIPKSLKLANLPTKIEKLERLSKSLGDINIYIKRDDQTGTEVSGNKVRKLEFAVQEALDQGCDYLITCGGIQSNHARATAAVAAKLDINSYLVLRSNGDDPVEGNYFLNKILGAEICLITPEEYRDNRMKVMEEIQRELAGQGHKAYILPEGASNGIGTFGYYQAMEEILEQEAELDVKFDAIVTAVGSGGTYAGLFYANKLRKNEAKIYGINVCDDADHFKNRVQELVHESIQYTKRPIHFKKEDIHMIDGYVGEGYAQSRQEELTFILDFAKLEGIILDPVYTGKAMYGLVEEIKKGSFNGFKNILFIHTGGLYGLFPKGNQLF

SEQ ID NO: 216 - DNA, 1053 bp, Rhodopseudomonas palustris
  Rhodopseudomonas palustris BisA53
  CDS (1)..(1053): transl_table=11
atggaatcgatcgcacggaatacggtagtgcgagtggaggagacgttggaaccacagttgctatcggctttcccccgggtgtccatcgcccatactccgacgccattcgagttcttggaacgactttccgcccgactcggcggaccagcgatctgggtgaagcgcgatgactgcaccgggcttgccggcggtggaaacaaggttcgtaagctcgaatttctgatcggcgccgcactcgagtccggggccgataccgtgattaccgcgggcgctattcagtccaatcacgcgcgccagacggccgcggcggccgcgcgcctgaatttgcggtccatcctggtgctcactgacacggtcggatgtcgcggccccgcgtatcgcaataacggcaatctgctgatcgacaggcttctgggcgccgacatccatctggtcggcggcgatgtcgacactgagtctgttttggaaagcatcgccgatcgagaacgcgaaaggggcaggagccccttcgttattcccgtcggtggctcgaatgcaccgggagtgctcggttatgtcgccggcttcttcgaactgcacgcgcaaatccaggaacaagccactgttttcgatgccattgtgctgccaaccggcagtggaggcacccaggccggactgatcctcggtgctgccttctccggatggtgcggcgctatcatcggaatcagcgtcggagcctcagccgaacgccagaggatgaaaatcgcgaagtcgctgcgatccgccgccgctctgctcgatattgaagactccgacagcaaccgggcggacatcctggtcgacgatcgctttgtcggtcccggctacggcgaacctgcccccgagaccatagacgcgatccgcatcgcggcggaaaccgaggggcttttgctggaccctgtctacagcggcaaagcgatggctgggctcatagcgctgatacgcgcgggtcggtttcggcgcgatcagaacgcggtgtttcttcacaccggcggtgcccaggcactcagcgcgtatccagaacacttcatataa

SEQ ID NO: 217 - protein, 350 aa, Rhodopseudomonas palustris
  Rhodopseudomonas palustris BisA53
MESIARNTVVRVEETLEPQLLSAFPRVSIAHTPTPFEFLERLSARLGGPAIWVKRDDCTGLAGGGNKVRKLEFLIGAALESGADTVITAGAIQSNHARQTAAAAARLNLRSILVLTDTVGCRGPAYRNNGNLLIDRLLGADIHLVGGDVDTESVLESIADRERERGRSPFVIPVGGSNAPGVLGYVAGFFELHAQIQEQATVFDAIVLPTGSGGTQAGLILGAAFSGWCGAIIGISVGASAERQRMKIAKSLRSAAALLDIEDSDSNRADILVDDRFVGPGYGEPAPETIDAIRIAAETEGLLLDPVYSGKAMAGLIALIRAGRFRRDQNAVFLHTGGAQALSAYPEHFI

SEQ ID NO: 218 - DNA, 1020 bp, Bradyrhizobium sp.
  Bradyrhizobium sp. BTAi1
  CDS (1)..(1020): transl_table=11
gtgcttcggctcgacaagttcaagaagtatccactcaccttcggcgcgaccccgatcgagcatctcccgcgcctgaccgcggcgctcggcggcaaggtgcagatctacgccaagcgcgacgactgcaattccggcctcgcgatgggcggcaacaagctgcgcaagctcgaatacatcgtgcccgacgcgatcgagtcgaatgccgacacgctggtgtcgatcggtggcgtgcagtccaaccatacccgcatggtggcggcgaccgcggccaagatcggcatgaagtgcgtggtggtgcaggagagctgggtgccgcacgaggacgcggtctatgaccgcgtcggcaacatcctgatgacgcgcctgatgggcgccgacagccgcatcgtgcccgacggcttcgacatcggcatccgcaagagctgggaagacgcgatccagtcggtgaaggatgccggcggcaagccctacggcattccggccggcgcctccgtgcacaagttcggcggtcttggctatgtcggcttcgccgaggaggtgagggcgcaggaagccgagatgggcatcaagttcgactacatcatcgtctgcgtggtcaccggctcgacccaggccggcatgatcgtcggcttcgccgccgacggccgcgccgaccgcgtcatcggcatcgacgcctccggcacgccggagcagacccgcacccaggtgcggcagatcgtcgacaacactgctgagctcgtcgagctcggccgcaaggtgcgcgacgacgagatcgtcatcctcgaagactacgcctatccggcctatggtgtcccgagcgccgagaccaacgaggccattcggctggccgcccgcaccgaggcgatgatcaccgacccggtctatgagggcaagtcgatgcagggcatgatcgacctggtcaagaagggctacttcccggagggctcgaaggtgctctacgcccatctcggcggcgcccccgcgatcaacggctacagctacacgtaccgcaacggctga

SEQ ID NO: 219 - protein, 339 aa, Bradyrhizobium sp.
  Bradyrhizobium sp. BTAi1
MLRLDKFKKYPLTFGATPIEHLPRLTAALGGKVQIYAKRDDCNSGLAMGGNKLRKLEYIVPDAIESNADTLVSIGGVQSNHTRMVAATAAKIGMKCVVVQESWVPHEDAVYDRVGNILMTRLMGADSRIVPDGFDIGIRKSWEDAIQSVKDAGGKPYGIPAGASVHKFGGLGYVGFAEEVRAQEAEMGIKFDYIIVCVVTGSTQAGMIVGFAADGRADRVIGIDASGTPEQTRTQVRQIVDNTAELVELGRKVRDDEIVILEDYAYPAYGVPSAETNEAIRLAARTEAMITDPVYEGKSMQGMIDLVKKGYFPEGSKVLYAHLGGAPAINGYSYTYRNG

SEQ ID NO: 220 - DNA, 987 bp, Escherichia coli
  Escherichia coli 101-1
  CDS (1)..(987)
atgccactgcataatttaacccgttttccacggttggagtttatcggcgcgccaacgccgctcgaatatctgccgcgcttttctgattatcttggacgggaaattttcatcaaacgggatgacgtcacacccatggcaatgggcggcaataaattacgtaagctggaatttctcgcggcagatgccctgcgcgaaggtgccgatacgctgattactgccggcgcgatccagtctaaccatgtgcgccagactgccgcagtcgcggcgaaactcggtctgcactgcgtggcgctgctggaaaatcctattggcacaaccgcagaaaactatttaactaacggcaatcgtttgttgctggatctgttcaatacccagattgaaatgtgcgatgcactgaccgatcccaatgcccaactggaagagctggcgacgcgagtcgaagcacaaggctttcgcccgtatgtcattccggttggcggttctaatgctcttggcgcgctaggttatgtggagagtgcgctggaaatcgcgcaacagtgtgaaggggcggttaatatttcgtcggtggtagtcgcatcgggcagtgccggaactcacgccggactggctgttgggctggaacacctgatgcctgaaagcgaactgattggcgtgaccgtgtcgcgttccgttgccgatcagttgccgaaagtggttaacctacaacaggcgattgcgaaagaactggagctgaccgcatcagcggaaattttactctgggatgactattttgcacctggctacggcgtgccgaacgacgaaggcatggaagcagtgaaattgctggcgcggctggaaggcattctgcttgatcctgtgtataccggaaaagcgatggcggggctgattggcggtatcagtcagaaacgcttcaaagatgaagggccgattctgtttattcataccggcggtgcgcctgcgctgttcgcctatcatccccacgtttag

SEQ ID NO: 221 - protein, 328 aa, Escherichia coli
  Escherichia coli 101-1
MPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIGGISQKRFKDEGPILFIHTGGAPALFAYHPHV

SEQ ID NO: 222 - DNA, 1017 bp, Ralstonia solanacearum
  Ralstonia solanacearum UW551
  CDS (1)..(1017): transl_table=11
atgaacctgaacaagcatccccgccatccgctgaccttcggccccacgcccatccagccgctcaagcggctatcggcccatctgggcggcaaggtcgagctctatgccaagcgcgaagactgcaacagtggcctggccttcggcggcaacaagacacgcaagctcgagtacctggtgccggaggtcctggccgggggctacgacacgctggtatcgatcggcggcatccagtccaaccagacgcggcaggtcgcggcggtggccgcgcacctggggttgaagtgcgtgctggtgcaggagaactgggtcaactattccgacgcggtttatgaccgggtgggcaacatcgagctgtcgcgcatcctgggcgcggacgtgcgcctggatgcggccggtttcgacatcggcatccgcccgagctgggagcaggcgatggaggacgtgcgccgcgcgggcggcaagccgttcccgattccggccggctgctcggagcacccgctgggcggcctgggcttcgtcggtttcgccgaggaggtgcggcagcaggaggccgagctcggtttccgtttcgactacatcgtggtgtgctcggtcacgggcagcacgcaggcggggatggtggtgggcttcgcggcggacggccgcgccgaccgggtgatcggcatcgacgcatcggccaagcccgggaagacacgcgagcagatcctgcggatcgcccgcgacaccgccaggctggtcgaactcggccgcgacatcgcggaagccgacgtggtactcgatacgcgctatggcggtcccgaatacggcctgccgaacgaaggcacgctggaggcgatccggctgtgcgcgcgccaggaaggcatgctgaccgacccggtgtacgagggcaagtcgatgcacggcatgatcgaccgggtgcgcaacggcgagtttcccgagggctcgcgcgtgctgtatgcccacctgggcggcgtgccggcgctcaatgcctacagctttctcttccgcaatggctga

SEQ ID NO: 223 - protein, 338 aa, Ralstonia solanacearum
  Ralstonia solanacearum UW551
MNLNKHPRHPLTFGPTPIQPLKRLSAHLGGKVELYAKREDCNSGLAFGGNKTRKLEYLVPEVLAGGYDTLVSIGGIQSNQTRQVAAVAAHLGLKCVLVQENWVNYSDAVYDRVGNIELSRILGADVRLDAAGFDIGIRPSWEQAMEDVRRAGGKPFPIPAGCSEHPLGGLGFVGFAEEVRQQEAELGFRFDYIVVCSVTGSTQAGMVVGFAADGRADRVIGIDASAKPGKTREQILRIARDTARLVELGRDIAEADVVLDTRYGGPEYGLPNEGTLEAIRLCARQEGMLTDPVYEGKSMHGMIDRVRNGEFPEGSRVLYAHLGGVPALNAYSFLFRNG

SEQ ID NO: 224 - DNA, 1011 bp, Roseovarius nubinhibens
  Roseovarius nubinhibens ISM
  CDS (1)..(1011): transl_table=11
atggacaggttcgaccggctgctcgccccgtttcctcaggcagggttcatgcccgcgccgaccccgcttgagcggctcgaccggctgtcggagctctatgatctcgatctctgggtcaagcgcgatgacctgacgcgcatcggctttggcggcaacaagatccgccagctcgattactatttcggcgcggcgctggccgagggggcggatgtggcgctcatcaccggggcggtgcagtcgaactatgtgcgctccgccgccgcctgtgccgcgcgacttggcatgggggcggtggtgcagcttgaagatcgggtgccgggcaagggcgcgctctatcacagctcgggcaatgtgttgctggacaagctgcttggggccgagatcctgcattaccctgagggcgaggatgaggcgggggccgaccgggcgcttcatgcccgcgccgaagagctgcgagccgaggggcgcaagccgtttgtcattccgctgggccttgagaacccgcccaagggggcgctggggtacatgcaatgcggccgcgaaatcctggcgcaggatgcggcagggtttgaccattatgtcgtggcctctggcagcggggcgacccataccgggctcttggccgggctgcggctgtgcggggcaagcgctccggtgcatggcatctgtgtgcgccgtgacgccgaggcccagcgcgcccggatcgggcgtctcgcggagctcttggcagagcttctgggcgaggcggtgttcggggcggcggatatcgacatctgggatggggcgctcgcccccggctatggccggatgggcgagaccacgcgccgggcgctcgatcagatggcacgctatgaggggctcttcctcgatccggtctataccgccaagagctttgccggggtcgaggggctcctgcaggagggggtgatccagccgggcgcacgggtctgtttcatccatagcggcggtttgcccgcgctctttgcctatggcgaggatctgctcgcatga

SEQ ID NO: 225 - protein, 336 aa, Roseovarius nubinhibens
  Roseovarius nubinhibens ISM
MDRFDRLLAPFPQAGFMPAPTPLERLDRLSELYDLDLWVKRDDLTRIGFGGNKIRQLDYYFGAALAEGADVALITGAVQSNYVRSAAACAARLGMGAVVQLEDRVPGKGALYHSSGNVLLDKLLGAEILHYPEGEDEAGADRALHARAEELRAEGRKPFVIPLGLENPPKGALGYMQCGREILAQDAAGFDHYVVASGSGATHTGLLAGLRLCGASAPVHGICVRRDAEAQRARIGRLAELLAELLGEAVFGAADIDIWDGALAPGYGRMGETTRRALDQMARYEGLFLDPVYTAKSFAGVEGLLQEGVIQPGARVCFIHSGGLPALFAYGEDLLA

SEQ ID NO: 226 - DNA, 1017 bp, Roseovarius nubinhibens
  Roseovarius nubinhibens ISM
  CDS (1)..(1017): transl_table=11
atgcatctcgcccgtttcccccgccgcttcatcgcccacctgcccaccccgctcgaacgtctcgaccgtctgagcgccgaactcggcggcccggaaatctggatcaagcgcgacgattgcaccggcctctcgaccggcggcaacaagacccgcaagctggaattcctcatggccgaggcggaactgcaaggcgccgagatcgtcatgacccaaggcgcgacccagtcgaaccacgcccgtcagaccgccgcgttcgccgccaagctcggcatgaaatgccacatcctgctcgaggaccgcaccggctcgaacgaggcgaactacaaccacaatggcaacgtgctgctcgaccatctgcacggcgcgaccaccgaaaagcgccccggcggcggtgacatgaatgccgagatggaaaagctcgccgatgaatggcgtgccgacggcaagaaagtctacacgatccccggcggcggctcgaacccgaccggcgcgctcggctatgtcaactgcgccttcgaactgctggcccaggccaatgatggcggtctcaagatcgaccatatcgtgcatgccaccggcagcgccggcacgcaggccggtctgatcaccggcctcaaggcgatgaatgcgcaaatcccgctgctcggcatcggcgtgcgcgcccccaaaccgaagcaggaagaaaacgtctacaacctcgcctgcgccacggctgaaaagctcggctgccccggcgtcgtcgcccgcgaagatgttgtcgccaacaccgattacgtcggccagggctatggcatcccgaccgaaagcggcatggaagcgatcaagatgttcgccgagctggaatcgatcctgctcgatccggtttattccgcaaaaggcgcggcaggctttattgacttgatccgcaaagggcatttcaagaagggcgagcgcgtcgtgttcctccacaccggcggggccgcagccctgttcggctatgatggcgcgtttgatttctcgtcccgctgggtcggctga

SEQ ID NO: 227 - protein, 338 aa, Roseovarius nubinhibens
  Roseovarius nubinhibens ISM
MHLARFPRRFIAHLPTPLERLDRLSAELGGPEIWIKRDDCTGLSTGGNKTRKLEFLMAEAELQGAEIVMTQGATQSNHARQTAAFAAKLGMKCHILLEDRTGSNEANYNHNGNVLLDHLHGATTEKRPGGGDMNAEMEKLADEWRADGKKVYTIPGGGSNPTGALGYVNCAFELLAQANDGGLKIDHIVHATGSAGTQAGLITGLKAMNAQIPLLGIGVRAPKPKQEENVYNLACATAEKLGCPGVVAREDVVANTDYVGQGYGIPTESGMEAIKMFAELESILLDPVYSAKGAAGFIDLIRKGHFKKGERVVFLHTGGAAALFGYDGAFDFSSRWVG

SEQ ID NO: 228 - DNA, 900 bp, Pseudomonas aeruginosa
  Pseudomonas aeruginosa C3719
  CDS (1)..(900)
ttgcagcgtctcgaactcgactggctgcaacgggccggggtcgaactggcgctgctgcgcctggaccaggccgatccgctgatctccggcaacaaggggttcaagctcgcgccacacctggcgctggcccacgagcaggggctggacggcctgatcagcctcggcggcgcccattccaaccacctgcacgcgctggccggcgctggcgcgcgtttcggtttccgttgcgtcggcctgttgcgcggacacgaagtcgatacgccgacggtgcgcgacctgcgcagtctcggcatggaactgcactggctcggctacggcggctatcgccagcggcatgccgccggcttctggcttccctggcgggaacgttacccaggcttgctgccggtcgccgagggcggtggcgggctgctgggcgcgcgcggttgcatcgggctggtggagcgcatggcgacccagttgccgacgctcggctgggacgattacgacgcgatctgggtggccgccggtaccggtacgacactggccggcctggtgctcggcgaggctgggcggcatcccgtggtgggcgcgctggcggtgccggaggaccacggcgtcgccgcccaggtcgcggcgacccttgccgaggcgggctgggccgataccggctatcgcctgctggacgccagccgtggcggtttcgcctgtctcgatgggaggttggcgcggttcatcgtcgagttcgagacggccagcggcgtcgccctcgaaccgctgtacaccggcaaactgctgctcgccctgcgcgaggccgtggagagcggcgcggtggctcgcggcagccggctggtggcgctgcacagcggaggcctgcagggccgccgggcattgcaggagcgtttgctggcgttgctctga

SEQ ID NO: 229 - protein, 299 aa, Pseudomonas aeruginosa
  Pseudomonas aeruginosa C3719
MQRLELDWLQRAGVELALLRLDQADPLISGNKGFKLAPHLALAHEQGLDGLISLGGAHSNHLHALAGAGARFGFRCVGLLRGHEVDTPTVRDLRSLGMELHWLGYGGYRQRHAAGFWLPWRERYPGLLPVAEGGGGLLGARGCIGLVERMATQLPTLGWDDYDAIWVAAGTGTTLAGLVLGEAGRHPVVGALAVPEDHGVAAQVAATLAEAGWADTGYRLLDASRGGFACLDGRLARFIVEFETASGVALEPLYTGKLLLALREAVESGAVARGSRLVALHSGGLQGRRALQERLLALL

SEQ ID NO: 230 - DNA, 900 bp, Pseudomonas aeruginosa
  Pseudomonas aeruginosa 2192
  CDS (1)..(900)
ttgcagcgtctcgaactcgactggctgcaacgggccggggtcgaactggcgctgctgcgcctggaccaggccgatccgctgatctccggcaacaaggggttcaagctcgcgccacacctggcgctggcccgcgagcaggggctggacggcctgatcagcctcggcggcgcccattccaaccacctgcacgcgctggccggcgctggcgcgcgtttcggtttccgttgcgtcggcctgttgcgcggacacgaagtcgatacgccgacggtgcgcgacctgcgcagtctcggcatggaactgcactggctcggctacggcggctatcgccagcggcatgccgccggcttctggcttccctggcgggaacgttacccaggcttgctgccggtcgccgagggcggtggcgggctgctgggcgcgcgcggttgcatcgggctggtggagcgcatagcgacccagttgccgacgctcggctgggacgattacgacgcgatctgggtggccgccggtaccggtacgacactggccggcctggtgctcggcgaggccgggcggcatcccgtggtgggcgcgctggcggtgccggaggaccacggcgtcgccgcccaggtcgcggcgacccttgccgaggcgggctgggccgataccggctatcgcctgctggacgccagccgtggtggtttcgcccgcctcgatgggcgattggcgcggttcatcgtcgagttcgagacggccagcggcgtcgccctcgaaccgctgtacaccggcaagctgctgctcgccctgcgcgaggccgtggagagcggcgcggtggctcgcggcagccggttggtggcgctgcacagcggaggcctgcagggccgccgggcattgcaggagcgtttgctggcgttgctctga

SEQ ID NO: 231 - protein, 299 aa, Pseudomonas aeruginosa
  Pseudomonas aeruginosa 2192
MQRLELDWLQRAGVELALLRLDQADPLISGNKGFKLAPHLALAREQGLDGLISLGGAHSNHLHALAGAGARFGFRCVGLLRGHEVDTPTVRDLRSLGMELHWLGYGGYRQRHAAGFWLPWRERYPGLLPVAEGGGGLLGARGCIGLVERIATQLPTLGWDDYDAIWVAAGTGTTLAGLVLGEAGRHPVVGALAVPEDHGVAAQVAATLAEAGWADTGYRLLDASRGGFARLDGRLARFIVEFETASGVALEPLYTGKLLLALREAVESGAVARGSRLVALHSGGLQGRRALQERLLALL

SEQ ID NO: 232 - DNA, 957 bp, Burkholderia cenocepacia
  Burkholderia cenocepacia PC184
  CDS (1)..(957)
ttgccgcgcctcggcaaggcgctgggtggcaaagtgcatctctatgcaaaacgcgaagactgcaacagcggcctggcgttcggcggcaacaagacccgcaagctcgagtacatcgtgccggacgtgctggcgagcggcgccgacacgcttgtatcgattggcggcatccagtcgaaccagacgcgtcaggtcgcggcagtcgcggctcatcttggcctgaaatgcgtgctggttcaagaaaactgggtcaactactcggacgctgtgtatgaccgcgttggcaacattcagatgtcccgcatgatgggcgccgacgttcggctggtcagcgacggcttcgacatcggcattcgtccgagctgggaagaggcgctggagagtgtccgcaacgcgggcgggaagccgtatccgatccccgccggttgttccgagcatcggcttggcggcctcgggttcgtcggtttcgcggaggaagtgcgcgcccaggaagccgaactcggattcaagttcgactacatcgtcgtgtgttcggtgaccggaagcacgcaggccggcatggtcgtggggttcgcggcggacggacgcgcggatcgcgtgatcggtatcgatgcgtcggccaaacccgagcagacgcgcgagcagattcttcgcgtcgcacgccagaccgccgatctcgtggaactcgaacggccgatcgaggacgcggacgtggtgctcgatacgcgctacgggggccctgaatacggcttgccgtcggaagggacgctcgaagcgattcgactgtgcgcgaagaccgagggaatgctgaccgacccggtttatgaaggcaagtcgatgcacgggatgatcgacagggtgcgccgcggcgagtttccggaagggtcccgggtcttgtatgcgcacctcggtggcgtccccgcattgaacgcatacagcttcctgttcaagaacggttga

SEQ ID NO: 233 - protein, 318 aa, Burkholderia cenocepacia
  Burkholderia cenocepacia PC184
MPRLGKALGGKVHLYAKREDCNSGLAFGGNKTRKLEYIVPDVLASGADTLVSIGGIQSNQTRQVAAVAAHLGLKCVLVQENWVNYSDAVYDRVGNIQMSRMMGADVRLVSDGFDIGIRPSWEEALESVRNAGGKPYPIPAGCSEHRLGGLGFVGFAEEVRAQEAELGFKFDYIVVCSVTGSTQAGMVVGFAADGRADRVIGIDASAKPEQTREQILRVARQTADLVELERPIEDADVVLDTRYGGPEYGLPSEGTLEAIRLCAKTEGMLTDPVYEGKSMHGMIDRVRRGEFPEGSRVLYAHLGGVPALNAYSFLFKNG

SEQ ID NO: 234 - DNA, 1017 bp, Burkholderia cenocepacia
  Burkholderia cenocepacia PC184
  CDS (1)..(1017)
atgaatctgcaacgcttcccccgttatccgctgacgttcggcccgacgcccatccagccgctcaagcgcctgagcgcccatctcggcggcaaggtcgagctgtatgcgaagcgcgaggactgcaacagcggcctcgcattcggcggcaacaagacgcgcaagctcgaatatctcgttcccgacgcgctcgcgcaaggtgccgacacgctcgtatcgatcggcggcgtgcagtcgaatcagacacgccaggtcgcggctgtcgccgcgcatctcggaatgaaatgcgtgctcgtgcaggagcactgggtcaactatgaagatccggtgtacgaccgggtcggcaacatccagttatcgcggatgatgggcgccgacgtgcggctcgtatccgacggtttcgacatcggcattcgccgcagttgggaagaagcgatggagagcgtgcgacaggcggggggcaagccgtatccgattccggccggctgctccgagcatccgctcggcgggctcgggttcgtcggcttcgcggaagaggtgcgggcgcaggaagcgcagctcggcttcaagttcgactacgtcgtcgtctgctcggtgacgggcagcacgcaggcgggaatggtcgtgggcttcgcggccgacggacgcgcggaccgcgtgatcggcatcgacgcatcggcgaagccggaacagacacgcgaacagatcacgcgcatcgcacggcatacggccgagctggtcggactgggccgcgatatcgtcgaacaggacgtcgtgctcgacacgcgttacggcgggcccgaatatgggctgccgagcgacggcacgctggaagcgattcggctgtgcgcacggctggaaggcatgctgaccgatcccgtttatgaagggaaatcgatgcacgggatgatcgacaaggtgcggctcggggaattcgagccggggtcgaaggtgctgtatgcgcacttgggcggggtgccagcgttgagcgcgtaccacgggatttttcgtaacgggtga

SEQ ID NO: 235 - protein, 338 aa, Burkholderia cenocepacia
  Burkholderia cenocepacia PC184
MNLQRFPRYPLTFGPTPIQPLKRLSAHLGGKVELYAKREDCNSGLAFGGNKTRKLEYLVPDALAQGADTLVSIGGVQSNQTRQVAAVAAHLGMKCVLVQEHWVNYEDPVYDRVGNIQLSRMMGADVRLVSDGFDIGIRRSWEEAMESVRQAGGKPYPIPAGCSEHPLGGLGFVGFAEEVRAQEAQLGFKFDYVVVCSVTGSTQAGMVVGFAADGRADRVIGIDASAKPEQTREQITRIARHTAELVGLGRDIVEQDVVLDTRYGGPEYGLPSDGTLEAIRLCARLEGMLTDPVYEGKSMHGMIDKVRLGEFEPGSKVLYAHLGGVPALSAYHGIFRNG

SEQ ID NO: 236 - DNA, 1017 bp, Burkholderia dolosa
  Burkholderia dolosa AUO158
  CDS (1)..(1017)
atgaacctgcaacgcttcccccgttatccgctgacgttcggcccgacgccgatccagccgctcaagcgcctgagcgcgcatctgggcggcaaggtcgagctgtacgcgaagcgcgaggactgcaacagcggcctcgcgttcggcggcaacaagacgcgcaagctcgaatatctggtccccgacgcgctcgcgcagcacgcggacacgctcgtgtcgatcggcggcgtgcagtcgaaccagacacgccaggtcgcggccgtcgccgcgcatctcggcatgaagtgcgtgctcgtgcaggagcactgggtcaactatgacgatccggtgtacggccgcgtcggcaacatccagttgtcgcggatgatgggcgccgacgtgcggctggtcgacgacggcttcgacatcggcattcgccgcagctgggaagaagcgatggagagcgtgcggcaggcgggcggcaagccgtatccgattccggccggctgctccgagcatccgctcggcggcctcgggttcgtcggcttcgcggaagaagtgcgcgcgcaggaggcgcagctcggtttccggttcgactacatcgtcgtgtgctcggtgacgggcagcacgcaggcgggcatggtggtcggcttcgcggccgacggacgcgcggatcgcgtgatcggcatcgatgcgtcggcgacgcccgagcgcacgcgcgaacagatcacgcggatcgcgcggcacacggccgagctggtcgatctcgggcgcgacatcggcgaccgcgacgtcgtgctcgacacgcgctatgcgggcccggaatacgggctgccgaacgacggcacgctcgacgcgattcgtctgtgcgcgcggctcgaaggcgtgctgaccgatcccgtgtacgaaggcaaatcgatgcacgggatgatcgacaaggtacggcgcggcgaattcgagcccggatcgaaggtgctgtatgcgcacctcggcggcgtgccggcgttgagcgcgtatgcggggatcttcgcgaacgggtga

SEQ ID NO: 237 - protein, 338 aa, Burkholderia dolosa
  Burkholderia dolosa AUO158
MNLQRFPRYPLTFGPTPIQPLKRLSAHLGGKVELYAKREDCNSGLAFGGNKTRKLEYLVPDALAQHADTLVSIGGVQSNQTRQVAAVAAHLGMKCVLVQEHWVNYDDPVYGRVGNIQLSRMMGADVRLVDDGFDIGIRRSWEEAMESVRQAGGKPYPIPAGCSEHPLGGLGFVGFAEEVRAQEAQLGFRFDYIVVCSVTGSTQAGMVVGFAADGRADRVIGIDASATPERTREQITRIARHTAELVDLGRDIGDRDVVLDTRYAGPEYGLPNDGTLDAIRLCARLEGVLTDPVYEGKSMHGMIDKVRRGEFEPGSKVLYAHLGGVPALSAYAGIFANG

SEQ ID NO: 238 - DNA, 1092 bp, Polaromonas naphthalenivorans
  Polaromonas naphthalenivorans CJ2
  CDS (1)..(1092): transl_table=11
atgccctccttttttgcggccatcacagtccacgcaatggggctttcaccggaaccacgatccatgccactcacgctcaatctccagaagtttccccggcattcgctgacgttcgggcccacgcccattcagccgctcaagcgcctgagcgcccacctgagcggcaagattgagctctacgccaaacgcgaggactgcaacagcggcttggccttcggcggcaacaagacccgcaagctggagtacctgattcccgaggcgctggcgcaaggctgcgacacgctggtctctattggcggcatccagtccaaccagacgcgccaggtggcggcggtggcggcgcacctgggcatgaagtgcgtgctggtgcaggaaaactgggtgaactattccgacgccgtgtacgaccgcgtcggcaacatcgaaatgtcacgcatcatgggtgctgacgtgcgcctggatgcggccggtttcgatatcggcattcgcccgagctgggaacaggccatggacgatgtgcgccaggccggaggcaagcccttcgccattccagctggctgctccgaacatccttatggtgggctgggctttgtcggctttgccgaagaggtgcgggcgcaggaagccgagctgggcttcaagttcgactacatcgtcgtctgctcggtcaccggcagcacgcaggccggcatggtggttggttttgccgcagatggtcgtgccgaccgggtgataggcattgatgcctccgccaagcctgagcaaaccagtgcgcaaatcctgcgcattgcgcagaacaccgccaggctggtcgagctggaccgtgacatcactgcgaaagacgtggtgctcgatacccgctacggcgggcccgagtacggcctgccgagcgaaggcacgctggaagccatccgcctgtgtgcccggcaggagggcatgctgaccgacccggtctatgaaggcaagtccatgcacggcatgatcgacatggtgcgccgcggtgagttccccgagggttcccgggtgctgtatgcccatctgggtggtgtacctgcgctcaatgcctacagcttcctgtttcgcaacggctga

SEQ ID NO: 239 - protein, 363 aa, Polaromonas naphthalenivorans
  Polaromonas naphthalenivorans CJ2
MPSFFAAITVHAMGLSPEPRSMPLTLNLQKFPRHSLTFGPTPIQPLKRLSAHLSGKIELYAKREDCNSGLAFGGNKTRKLEYLIPEALAQGCDTLVSIGGIQSNQTRQVAAVAAHLGMKCVLVQENWVNYSDAVYDRVGNIEMSRIMGADVRLDAAGFDIGIRPSWEQAMDDVRQAGGKPFAIPAGCSEHPYGGLGFVGFAEEVRAQEAELGFKFDYIVVCSVTGSTQAGMVVGFAADGRADRVIGIDASAKPEQTSAQILRIAQNTARLVELDRDITAKDVVLDTRYGGPEYGLPSEGTLEAIRLCARQEGMLTDPVYEGKSMHGMIDMVRRGEFPEGSRVLYAHLGGVPALNAYSFLFRNG

SEQ ID NO: 240 - DNA, 1020 bp, Burkholderia mallei
  Burkholderia mallei 10229
  CDS (1)..(1020)
atgaacacgacgacgctctcgacgaaactgaacgccttcgcccgcctgaacctgatcgacgcgccgacgccgctgcagtacttgccgcgcctgtccgcgcacgtcggccgcgacatccacgtgaagcgcgacgactgcacgccgctcgcgatgggcggcaacaagctgcgcaagctcgaattcctcgccgcggacgcgctcggccaaaacgcggacgtgctggtgaccgcgggcgcgatccagtcgaatcacgtccggcagacggccgcgctcgtcgcgcagctcggcctcggctgtgtcgcgctgctcgaaaacccgatcgcagccgcgcgcgacgattatctgcaaagcggcaaccggctgctgctcgatctgttcgacgtgcgcgcgcacgtcgtcgacgggctcgacgacgtcgaccggcaactcgaagccgccgcgcggcggctgcgcgacgaagggcggcgcccgtacgtgatcccgatcggcggatcgaatccgctcggcgcgctcggctacgtgcgcgcgggcctcgagctcgcgcagcagatccgcgcggccgagcgcgatttcgcggctgtcgtgctcgcgtccggcagcgccggcacgcacgcgggcctcgcgttcgcgctcgcgcacgcgttgcccgggctgccggtgatcggcgtgacggtatcgcgcaccgacgcgcagcagcgcccgaaggtgcggcatctgctcgacggcatgagcgggctgctcgacgtcgcgttgccggcgggcgcgcgcatcgatctgtgggacgactacttcgcgccgcgctacggcgagcccaatcgcgcgggcatcgacgcgctgcggctgctcgcgcgaaccgaggggctgctgctcgatccggtgtacacgggcaaggcgatggcgggtctcatcgacggcgtcgcgcgcggccgcttcgacggaaacggcccggtgctgttcgtgcatacgggcggcgcgcccgcgctgttcgcgtatcaggacgcgtgccgcgcgagccgatga

SEQ ID NO: 241 - protein, 339 aa, Burkholderia mallei
  Burkholderia mallei 10229
MNTTTLSTKLNAFARLNLIDAPTPLQYLPRLSAHVGRDIHVKRDDCTPLAMGGNKLRKLEFLAADALGQNADVLVTAGAIQSNHVRQTAALVAQLGLGCVALLENPIAAARDDYLQSGNRLLLDLFDVRAHVVDGLDDVDRQLEAAARRLRDEGRRPYVIPIGGSNPLGALGYVRAGLELAQQIRAAERDFAAVVLASGSAGTHAGLAFALAHALPGLPVIGVTVSRTDAQQRPKVRHLLDGMSGLLDVALPAGARIDLWDDYFAPRYGEPNRAGIDALRLLARTEGLLLDPVYTGKAMAGLIDGVARGRFDGNGPVLFVHTGGAPALFAYQDACRASR

SEQ ID NO: 242 - DNA, 957 bp, Roseovarius sp.
  Roseovarius sp. 217
  CDS (1)..(957): transl_table=11
atgaaccggctgaccgagcatctgggaggtccacgtttgtgggtgaagcgtgacgattgcacaggcctgtcgtcgggcggaaacaagacacgcaagctcgaattcctgatggccgatgctttggcgcagggcgtggatacgatcatcacccaaggtgccacccaatccaaccacgcgcgccagactgcggcggcggctgcgcggttcggaatggcctgccatatcctccttgaggatcggacggggtctgacgatccgcagtatacgctgaacggaaacgttcttcttgaccggctgcatggtgcgaccgtggccaagcgtcggggcggctcggatatggcgtccgagatggagacattggcagacaagctgcgcgcagacgggcggaggccttacatcattcccggcggtggctcgaacagcacgggcgcgcttggttatgtgaattgcgccttggagattgctgagcagtcggcaaccatggggctaaagattgatgcgctggtgcatgcgacgggcagttcgggcactcaggcggggttggtagcaggtctcgcggcgcttgaaagtgatatctatcttctcggcattggcgtgcgcgcgcctcaggaaaagcaggaaagcatggtctttgacctcgcacagcgcacgggtgcgcgcatgggatttgaagaggcgattcgtcgagagggtgtccgggcgaactgcgattacgtgggcgcgggatacggcattccgacgcaaggcatgatcgagagcgtccggcttttggcagagatcgaggggctgctgttcgacccggtctattccggcaaagggctagacggtctgattgatctgacacgcaagggggcctttgatggcatggagaatgtcgtctttctgcatactggcggttcagccgcgcttttcgcatatcccgacgtgtttgatctgccgggctaccagataaactga

SEQ ID NO: 243 - protein, 318 aa, Roseovarius sp.
  Roseovarius sp. 217
MNRLTEHLGGPRLWVKRDDCTGLSSGGNKTRKLEFLMADALAQGVDTIITQGATQSNHARQTAAAAARFGMACHILLEDRTGSDDPQYTLNGNVLLDRLHGATVAKRRGGSDMASEMETLADKLRADGRRPYIIPGGGSNSTGALGYVNCALEIAEQSATMGLKIDALVHATGSSGTQAGLVAGLAALESDIYLLGIGVRAPQEKQESMVFDLAQRTGARMGFEEAIRREGVRANCDYVGAGYGIPTQGMIESVRLLAEIEGLLFDPVYSGKGLDGLIDLTRKGAFDGMENVVFLHTGGSAALFAYPDVFDLPGYQIN

SEQ ID NO: 244 - DNA, 1017 bp, Roseovarius sp.
  Roseovarius sp. 217
  CDS (1)..(1017): transl_table=11
atgcatcttgcccgctatccccgccgctttctcgcccatctgccaacgccactggagcggctggatcgtttgaccaaggaattgaacgggccggaaatctggatcaagcgcgacgattgcaccggcctcagcaccggtggcaacaagacccgcaagctcgagttcctgatggccgaggccgaattgcagggcgcggatatggtgatgacccagggcgccacccagtccaaccacgcgcgccaaacggcggcctttgcggccaagctgggcatggattgccacctgctacttgaggacagaaccggctccaacaacgccaactacaacaatggcggcaacgtccttctggaccatatgcacggcgcgaccacggaaaagcgccccggcggcggcgatatgaatgccgagatggaaaaggtcgcggacaagttccgcgccgaggggcgcaatgtctataccatccccggtggtgggtcgaacccgacgggcgcgctaggctatgtcaactgcgcctttgagatgctggcgcagttcaatgatcgggcgctcaaggtggatcacattgtccatgccaccggaagtgcaggcacgcaggcggggctgatcaccgggctcaaagcgatgaatgcgcagattccgctcctcggaattggcgtgcgcgcgcccaaggcaaagcaggaagagaacgtctataacctcgcctgtgccactgctgaaaagctgggctgcgccggagtggtcaagcgcgaggatgtggtcgccaataccgattacgtcggcgaaggctatggtattcctacagaatccggcatcgaggcaattcacatgtttgccgagttggaggcgatcctgctcgatccggtctattcggccaagggggctgcgggctttatcgacctgatccgcaaggggcatttcaagaaaggcgagcgtgttgtgtttctgcataccgggggttctgttgcgctcttcggttatgacagcgcctttgatttctcgggccgctggaagaagtaa

SEQ ID NO: 245 - protein, 338 aa, Roseovarius sp.
  Roseovarius sp. 217
MHLARYPRRFLAHLPTPLERLDRLTKELNGPEIWIKRDDCTGLSTGGNKTRKLEFLMAEAELQGADMVMTQGATQSNHARQTAAFAAKLGMDCHLLLEDRTGSNNANYNNGGNVLLDHMHGATTEKRPGGGDMNAEMEKVADKFRAEGRNVYTIPGGGSNPTGALGYVNCAFEMLAQFNDRALKVDHIVHATGSAGTQAGLITGLKAMNAQIPLLGIGVRAPKAKQEENVYNLACATAEKLGCAGVVKREDVVANTDYVGEGYGIPTESGIEAIHMFAELEAILLDPVYSAKGAAGFIDLIRKGHFKKGERVVFLHTGGSVALFGYDSAFDFSGRWKK

SEQ ID NO: 246 - DNA, 909 bp, Cellulophaga sp.
  Cellulophaga sp. MED134
  CDS (1)..(909): transl_table=11
gtgaattttacttcaaaaaatcaatttgtctttgagcaaaatggctgtacgcttttcataaagcgtgaggacgagttacaccccaccgtttctggtaataagtttagaaagcttaagtataacctacttcaagccagagcacttggtcacgatacattactcacctttggtggtgcatactcaaatcatattgctgcaaccgcggcggcgggtaaactagaaggttttaaaactgtaggggttataaggggtgaggagttgggccgtgatcttaaaaaaacactagctcaaaaccctacgcttgcatttgcccactcttgtgggatggaatttcattttgttactagggctgagtataaggagaaggataaattacgctttcgcgaaagcgtaaaaaaaacctttaataacccatttattatacccgaaggaggtacaaatgcgcttgcaataaaaggatgtgaagagattctaactacagaggacagtcagtttgattatataagttgccctataggaacggcgggtacgatatctggtatcataaatagtgctggtaaacatcaaaaggtacttggtttccccgcgctaaaaggagattgggtacgtgatgaggtagcacaatatgtggatagtgagcaatgggaaatcatagccgactatcattgtggaggatatgcaaaagtaaatagagagttaatcacttttataaatgactttaaggaagcatacggcattccgcttgatcctgtgtatacgggtaagatgctttttgggctttcagacttgatgaatcgtgggtatttcccagagaattctcgtattttagccattcatacgggaggtttacaaggcatctcgggtatgaatactcgacttgcaaaaaagggactcccactcatacaatag

SEQ ID NO: 247 - protein, 302 aa, Cellulophaga sp.
  Cellulophaga sp. MED134
MNFTSKNQFVFEQNGCTLFIKREDELHPTVSGNKFRKLKYNLLQARALGHDTLLTFGGAYSNHIAATAAAGKLEGFKTVGVIRGEELGRDLKKTLAQNPTLAFAHSCGMEFHFVTRAEYKEKDKLRFRESVKKTFNNPFIIPEGGTNALAIKGCEEILTTEDSQFDYISCPIGTAGTISGIINSAGKHQKVLGFPALKGDWVRDEVAQYVDSEQWEIIADYHCGGYAKVNRELITFINDFKEAYGIPLDPVYTGKMLFGLSDLMNRGYFPENSRILAIHTGGLQGISGMNTRLAKKGLPLIQ

SEQ ID NO: 248 - DNA, 939 bp, Tenacibaculum sp.
  Tenacibaculum sp. MED152
  CDS (1)..(939): transl_table=11
atggactttaataaaccctatatttccgagaatcataaaatagagctacctattttaacacagaaaaatgtggcgctttatataaaaagagaagatgaaattcatccttttgtatcaggtaataaattcagaaaattaaaatacaacttagccgaagctaaaaagcaaaataaagctacattattaacttttggaggcgcattttcaaatcatatagtagcaacagctgttgctggtaatctcaatggttttaaaactattggtattattagaggtgaagaattggctaatgatttagaaaaaacactagctgaaaatgctactttaagagaggctcatctaaatggaatgacttttagatttatttctagagctgattatagaaataaagaacaaacaaattttatagcagatttaagtaaagaatttggcgatttttatttgattcctgaaggaggtacaaaccaactggctataaaaggttgtgaagaaattttaacaaatcaagacgcaattttcgattatatttgtttggctgttggaactggaggtactatttctggagttataaattcattgcaagatcatcaaaaatgtttgggatttcctgctttaaaaggaatttttttagaagaggaaatcaaaaaatatgtaaaatcagaagagaattggagtttacaaaccgattatcattttggaggttatgcaaaatataatgatgatttaattcgttttataaacacctttaaaaaccaaacagatattttattagaccctgtttatacagcaaaaatggtttacggtgttttagatttaataggtaaaaatcattttccagttaaaactaaaatacttgcaattcatacaggaggtttacaaggtattgttggtttcaataaaaagttagcagcaaaaaatcaatctttaatacaacaataa

SEQ ID NO: 249 - protein, 312 aa, Tenacibaculum sp.
  Tenacibaculum sp. MED152
MDFNKPYISENHKIELPILTQKNVALYIKREDEIHPFVSGNKFRKLKYNLAEAKKQNKATLLTFGGAFSNHIVATAVAGNLNGFKTIGIIRGEELANDLEKTLAENATLREAHLNGMTFRFISRADYRNKEQTNFIADLSKEFGDFYLIPEGGTNQLAIKGCEEILTNQDAIFDYICLAVGTGGTISGVINSLQDHQKCLGFPALKGIFLEEEIKKYVKSEENWSLQTDYHFGGYAKYNDDLIRFINTFKNQTDILLDPVYTAKMVYGVLDLIGKNHFPVKTKILAIHTGGLQGIVGFNKKLAAKNQSLIQQ

SEQ ID NO: 250 - DNA, 948 bp, Flavobacterium sp.
  Flavobacterium sp. MED217
  CDS (1)..(948): transl_table=11
atgagtgatgtaggtttttttgagaatgatttttatgacctgactataagtgcattaaatggatttgtaggaaacgaatttaacctagaagtagctatcaaacgcgaagatcaaattgacacatttgtttctggcaataagtttagaaagctcaagtataatttgattgaagctcaaaacctgcgtcaaaaaacacttcttacctttggcggagcattttctaatcatatcgcggctaccgccagagccggtcagcgctgtggttttaaaacgatcggagtcatacgcggtgaagaattgggcattaccttagatcaaacgcttcagcaaaaccctaccttgaagtttgcttatgaatgcggaatgcaatttgaattcgttacacgtaaagcttatcgggaaaaagaaagcgcagcattcaaccaaatgcttaaggagcaatttggtgatttttatagcattccagagggaggaacaaatgcactcgctgtaaaaggctgtaaagagattttatcagaaaacacaaaagattttgattacatcgcttgtgctgtgggaacaggaggaactattgcgggcattgtagaagccagtcttccgcatcaaaaggttttaggttttccggctttaaaaggtgattttctaaatgctgaaattaaaaaatatacttcaaaagccaattgggaacttatcaatacgtatcattttggaggctatgcaaaagtgaatgaggagcttgttcagtttataaatgattttaaaaagcagcacgggattcagctagatcctgtgtataccggtaaaatgatgtttggtcttacagatcttatgcgcaatgggtttttctctaaaaatacccgtattttagccgttcatactggaggcctgcaaggtattgccggaatgaatgctaaactttcaaaaaaaggatatcctcagattatttga

SEQ ID NO: 251 - protein, 315 aa, Flavobacterium
  Flavobacterium sp. MED217
MSDVGFFENDFYDLTISALNGFVGNEFNLEVAIKREDQIDTFVSGNKFRKLKYNLIEAQNLRQKTLLTFGGAFSNHIAATARAGQRCGFKTIGVIRGEELGITLDQTLQQNPTLKFAYECGMQFEFVTRKAYREKESAAFNQMLKEQFGDFYSIPEGGTNALAVKGCKEILSENTKDFDYIACAVGTGGTIAGIVEASLPHQKVLGFPALKGDFLNAEIKKYTSKANWELINTYHFGGYAKVNEELVQFINDFKKQHGIQLDPVYTGKMMFGLTDLMRNGFFSKNTRILAVHTGGLQGIAGMNAKLSKKGYPQII

SEQ ID NO: 252 - DNA, 876 bp, Campylobacter jejuni
  Campylobacter jejuni subsp. jejuni 260.94
  CDS (1)..(876): transl_table=11
ttgaatttcattaaaacaattagtcctatacaaaaaatcaattttaacggatttgaattttatattaaaagagatgatttattaggggaaattaatggaaataaagctaggaaacttgctttttatatccatcaaagatatcctaaaaatcaatcttttgtaagttatggaggaagccaaagtaatgctttggcggcattaagtatttttgctaaacaaagatcatataagcttgtttttgcttgtgaaaaaatttctacttttcttaagaataatccttgtggaaactatgctttagctttagaaaatggtgttgattttgtagaaaatatccattctttatccttaaagcaatttgctttgtctttgtgtaaaaaagatgatatttttatagaacaaggcatagctaatttagaagctcaatatggctatatggaacttgctcaagaaattcaaatgcaaagtcaaagtttaaagcttgattttgatatttttttaccttcgggtacaggcacttcggcagcttttttggcaaagtattctaaatttaaagtatttacttgcgcttgtgtaggtgatattaaatatcttaaaaaacaaattttaacattagatccaagctatgatttttcaaatttagaatttttaacaagtgataaaaaatatcactttgctaagccgtataaagaattttatgagctttatatggatttaaagttaaagtgcaatatagaatttgacttgttgtatgatattttaggattaagtatagcattaaaacaagagtggaaaaaaccattgctttatatacatcaaggtggaattttaggaaattccactatgttagagagatataaatttaaaaaattagtttaa

SEQ ID NO: 253 - protein, 291 aa, Campylobacter jejuni
  Campylobacter jejuni subsp. jejuni 260.94
MNFIKTISPIQKINFNGFEFYIKRDDLLGEINGNKARKLAFYIHQRYPKNQSFVSYGGSQSNALAALSIFAKQRSYKLVFACEKISTFLKNNPCGNYALALENGVDFVENIHSLSLKQFALSLCKKDDIFIEQGIANLEAQYGYMELAQEIQMQSQSLKLDFDIFLPSGTGTSAAFLAKYSKFKVFTCACVGDIKYLKKQILTLDPSYDFSNLEFLTSDKKYHFAKPYKEFYELYMDLKLKCNIEFDLLYDILGLSIALKQEWKKPLLYIHQGGILGNSTMLERYKFKKLV

SEQ ID NO: 254 - DNA, 900 bp, Marinomonas sp.
  Marinomonas sp. MED121
  CDS (1)..(900): transl_table=11
atgatacaccccttaacactcaccttagatgatcagcttttacgtgatagaaatatcagtgtgtgtatttatcgtggggatcttgagtatgcagacgcaccgggtaataagtggcataaattaagatttaatctggcagcagccaaagctcaaggtgcaaagcatctgataagttttggtggacctttctctaaccatttgcacgcgttagctaatacggcacaacaagaaggtatgatacctgttgcgattgttcggggagaattacagcctcaactgacgccgaccttacgtgattttgtagcagctggcggtattttgtggccaagtaagcgtgttgattaccgagcaggcatggaatctgactttgtgtcgagtcttaaaggttattatccagacgctttttgggtgccagaaggcgggtctaatagcttgggggtaaaaggttgttattactgggcaaatgctataaagcagcaagcggatgaaattggcagctttgatacctggctggtaagtgcgggaacaggtgcaaccagtgcaggttttttagccaatgataatgttcctaatatgcttgtctttcccgcgttaaaaggaggggaggccttgctatcagatattcactcccttgcgctgcaacaaaaccctgacagtcacttgcaacgtttatctattgtgggtgaatatcaccatggcggttacgcgagactgccaagtgaattaaaggactatattgagcaactgcatcaacttaaccctcatttaaggttagaccctgtttatacggccaaacttgtctatggggtagagcaagaaatacgcaaaggtaagttgacgaatcaaaagctgttgcttattcatacaggagggctgcagggttggcgcggatatcaataa

SEQ ID NO: 255 - protein, 299 aa, Marinomonas sp.
  Marinomonas sp. MED121
MIHPLTLTLDDQLLRDRNISVCIYRGDLEYADAPGNKWHKLRFNLAAAKAQGAKHLISFGGPFSNHLHALANTAQQEGMIPVAIVRGELQPQLTPTLRDFVAAGGILWPSKRVDYRAGMESDFVSSLKGYYPDAFWVPEGGSNSLGVKGCYYWANAIKQQADEIGSFDTWLVSAGTGATSAGFLANDNVPNMLVFPALKGGEALLSDIHSLALQQNPDSHLQRLSIVGEYHHGGYARLPSELKDYIEQLHQLNPHLRLDPVYTAKLVYGVEQEIRKGKLTNQKLLLIHTGGLQGWRGYQ

SEQ ID NO: 256 - DNA, 1008 bp, gamma proteobacterium
  gamma proteobacterium KT 71
  CDS (1)..(1008): transl_table=11
atgcacctagcccgctttccccgtttgcacttcgcccatctccccacccccctggaacccatgaaaaatctttccaaagccctggggggaccgaatatctggattaagcgcgacgactgcaccggtcttgcgggtgggggtaacaaaacccggaaacttgagttcctcatggccgatgcacagcaacagggcgcggataccatcattacccagggcgcaacgcagtcaaaccacgtgcgccaaaccgcggcgatcgcagcaaagctgggcatgcattgcgaggtggtcctggaagaccggaccggaagcaccatcgacgactacaactacaacggtaatgtgcttctggatgaactgttcgaagccgccatcagccgcgttcccggcggcacggatatgaacgaggccatggacgatcttgcccacaggctcacaagtgatggcaaaaagccatacatcatccccggcggcggctccaaccccatcggcgccctgggctatgttcactgcgccatggagttgctctatcaggcggacgttcaaggcctggcaatggatctggtgctgcacggcacaggcagtgcgggcacccaggcaggtcttgtcgccggttttgccgggagcaacagccaggtcccggtacttgggatcggcgtccgggcgcctaaagaaaaacaggaggacaacgtttttttactggcagagcgcaccgccgaattactcgggataccgggtgccgttcagcgtaaacacgtggaggcaaattgcgactatgtgggtgaaggctacggcatacctaccgagggcaccatcgaggccatcgagatctttgcccgcaccgagagcattctcctggaccccgtctattccggaaaaggtgctgcaggtcttgttgatcttgttcgtaaagggcatttccaaaaagatcagaacatcgtgtttatacacacggggggcgcccaggcactgtttgcctatcgcgacgcctttggctacggcaatcgctaa

SEQ ID NO: 257 - protein, 335 aa, gamma proteobacterium
  gamma proteobacterium KT 71
MHLARFPRLHFAHLPTPLEPMKNLSKALGGPNIWIKRDDCTGLAGGGNKTRKLEFLMADAQQQGADTIITQGATQSNHVRQTAAIAAKLGMHCEVVLEDRTGSTIDDYNYNGNVLLDELFEAAISRVPGGTDMNEAMDDLAHRLTSDGKKPYIIPGGGSNPIGALGYVHCAMELLYQADVQGLAMDLVLHGTGSAGTQAGLVAGFAGSNSQVPVLGIGVRAPKEKQEDNVFLLAERTAELLGIPGAVQRKHVEANCDYVGEGYGIPTEGTIEAIEIFARTESILLDPVYSGKGAAGLVDLVRKGHFQKDQNIVFIHTGGAQALFAYRDAFGYGNR

SEQ ID NO: 258 - DNA, 978 bp, gamma proteobacterium
  gamma proteobacterium KT 71
  CDS (1)..(978): transl_table=11
atgcaccccctcagcaatttcgcagcggcggttggtgttcccgagctttggatgaaacgagatgacctcacgggcttggaaggaggcggcaacaaaacgcgcaagctggaatttctggtaggagacgcgctggccaaaggcgccgacatgttggtgaccgttggggcgattcaatcgaatcatacgcgtcagactgccgccgccgcagccaagtccggtctcaaatgctcactgctgcattatgcgtggaccaaagatgctagtcctcaataccgaatagtgggcaacttactgataagtcatcttataggcgcggatctgtacgtggatgaaacggagcgaccgattgaggatcagggtcccctcgacgaattcatggcctttctccgggcgcagggtcataagccttacctgatacccggcggcgcgtcggagcatcgactcggatgttttgggtacatcaagtgtgctgcggaaattgcttcgcagatggatgcagccgacatccgctttgactaccttgtgcactgcacgggctccagtagcacccaggcgggactgctggcgggatttgccgctttgggcatagagacccgcatcgtcggcatatctgatgatggtgaagtagccataaagaaagcgagagtgctggagctggccaacgcggccttaaaggagttggacctaagtgcacgcgttaacgcgcaggacgtcgagatcatcgcctccagcaacaatgattacggagcgcccgatgaggagatcattaacagcattcgcctcctggctggcaaagaaggcttaatcgccgaccccgtctatgagggccgggcagttcatgggcttttaaagttgatcgaggatggacgcctggacaggaacacaaaggtgctgctcatgcacctgggcggttctcccgcgattcacgcctacgcagggcatttcggatccattcagttgagcccatttcaggcctga

SEQ ID NO: 259 - protein, 325 aa, gamma proteobacterium
  gamma proteobacterium KT 71
MHPLSNFAAAVGVPELWMKRDDLTGLEGGGNKTRKLEFLVGDALAKGADMLVTVGAIQSNHTRQTAAAAAKSGLKCSLLHYAWTKDASPQYRIVGNLLISHLIGADLYVDETERPIEDQGPLDEFMAFLRAQGHKPYLIPGGASEHRLGCFGYIKCAAEIASQMDAADIRFDYLVHCTGSSSTQAGLLAGFAALGIETRIVGISDDGEVAIKKARVLELANAALKELDLSARVNAQDVEIIASSNNDYGAPDEEIINSIRLLAGKEGLIADPVYEGRAVHGLLKLIEDGRLDRNTKVLLMHLGGSPAIHAYAGHFGSIQLSPFQA

SEQ ID NO: 260 - DNA, 927 bp, Flavobacteriales bacterium
  Flavobacteriales bacterium HTCC2170
  CDS (1)..(927): transl_table=11
ttggcactgaattctggactagtgcgaattgagaatcaaataataaatcttcccattcttgaagagaaaaaaataacactctttattaaaagagaggacaaaatacacccagtaatctccggaaataaatttcgaaaacttaagtataatctcaaagaggccaagaatagcagctataaagggttgttgacctttggtggtgcctattccaatcatattgctgccgtggcttgcgctgcaaatgaaaacaatctggccagtataggaatcattaggggagaggaattggcctttaagtggcaggataatccaactttacagcaggcggttgattttggaatgcaattgaaatttgtatctagatcggattataggaaaaaagattctcctgtatttattgaaaaattgggtcaagattttccagagtattatttggttcctgagggtggtaccaatgaacttgcggttaagggttgtaccgaaatattgactttcaaggatgagacatttgatctgatttgttgtgcggttggtacgggcggaactatatctggattgatcaattccatcaagccaaaacaacgggtccttggttttcctgctttgaaaggagattttttaagagaagatatttgtaaatttgcggcaaaccgtgattgggatttgcaactggattacaattttggtggttatgccaaggtaactcctgaacttatcaggtttataaatgagttcaaaaaaacgacagatatacctttggatccagtttatactggcaaaatgatgtttggaatagttgagatggtcaagaatgatgtttttagagagggtacaaaactattggcgatacatactggtggtttacaaggaatagaagggatgaaccgtatattgaaaaagaaagatttaccattaattgatttatga

SEQ ID NO: 261 - protein, 308 aa, Flavobacteriales bacterium
  Flavobacteriales bacterium HTCC2170
MALNSGLVRIENQIINLPILEEKKITLFIKREDKIHPVISGNKFRKLKYNLKEAKNSSYKGLLTFGGAYSNHIAAVACAANENNLASIGIIRGEELAFKWQDNPTLQQAVDFGMQLKFVSRSDYRKKDSPVFIEKLGQDFPEYYLVPEGGTNELAVKGCTEILTFKDETFDLICCAVGTGGTISGLINSIKPKQRVLGFPALKGDFLREDICKFAANRDWDLQLDYNFGGYAKVTPELIRFINEFKKTTDIPLDPVYTGKMMFGIVEMVKNDVFREGTKLLAIHTGGLQGIEGMNRILKKKDLPLIDL

SEQ ID NO: 262 - DNA, 924 bp, Alteromonas macleodii
  Alteromonas macleodii 'Deep ecotype'
  CDS (1)..(924): transl_table=11
gtgctatcccttgaagatttcaaaacttcactcacacttccttcgcctgtagaaccgttttttccaaaatggaaaggggctgagaaggtatcgctcttcgttaagcgagacgacgccatacaccctattatgtcggggaacaaatggcgcaagttaagtaacgctcttcccccttctctacccaaggcaatagtgagtttcgggggcggtttctctaatcacctccacgccctaggctttatctgctttaagttgggtatccctttcaccgcgattattcgaggtgactattcggctaccccctcaccgatgattaaagacttgatacagtggcaaactcacattgaatatgtggaccgtataacctacaaaaaacgtagcgatagcgcttatttaaatgaactaaagctgcagtttcccgatgcgattatcatcccagagggcggaagccaagcccaagcgcttcaagggataaaagatttggtcgatgaaatcgaggtagactttgattttatcgtcgcgccagtcgcaagcggcgcaaccttggcgggaattataaatgcattaaataaacgtaatcgtacaacggctactgactttcgttctcttcataaagtcattggcataggcgtactaaaaggtgaaggctatttagaggggttggttcagaaatttcttccgatatctaaacaccagacaagttggcatattgatcataactatcattttggtggctacgccaaagcgccaaatgagcttcaaaccttttgcaacgacttcaatgacaacatggaatttaaaatagagccagtttactcaggcaaagccttctgggcagttaaagatatgttggctaaaggtaagttcgaagaccgttctcgcattgttgtattgcacacgggcggtttgcaaggtgcaaggtaa

SEQ ID NO: 263 - protein, 307 aa, Alteromonas macleodii
  Alteromonas macleodii 'Deep ecotype'
MLSLEDFKTSLTLPSPVEPFFPKWKGAEKVSLFVKRDDAIHPIMSGNKWRKLSNALPPSLPKAIVSFGGGFSNHLHALGFICFKLGIPFTAIIRGDYSATPSPMIKDLIQWQTHIEYVDRITYKKRSDSAYLNELKLQFPDAIIIPEGGSQAQALQGIKDLVDEIEVDFDFIVAPVASGATLAGIINALNKRNRTTATDFRSLHKVIGIGVLKGEGYLEGLVQKFLPISKHQTSWHIDHNYHFGGYAKAPNELQTFCNDFNDNMEFKIEPVYSGKAFWAVKDMLAKGKFEDRSRIVVLHTGGLQGAR

SEQ ID NO: 264 - DNA, 927 bp, Polaribacter irgensii
  Polaribacter irgensii 23-P
  CDS (1)..(927): transl_table=11
ttgattaaagaaactaaaaatcaacaagttattcttccaattttagaagaaaaaaaagtgacgctttttataaaaagagaagatttaattcacccttacgtttcgggaaacaagtttcgaaaattaaagtacaatctacaagaagcaaaaaaactaaaaaagaaatcattacttacctttggaggggcattttccaatcatattttagcaacggcagttgcgggaaagttggcaggttttaagacctttggagttattaggggagatgagttgggtaaaaaccttgtaaaaactttagaagggaatgcaactttaaggaaggcacacgaaaacggaatgaagttgcagtttgtgacacgagagcaatatcggcagaaagcctcatttggatttattgaaaagatgaaaaataaatggggggatttttatttaattcccgagggaggaacaaacggtttagcagtagcaggttgtgaagaaattttaacaaaagaagattcggaatttaattatatttgcagcgccgtgggaacaggaggtactatttctggtttgataaagtcattacagaagcaccaaaaagtaataggcttccctgctttgaaaggaaattttttatctgaagagattaaaaaatatacaattagaaaagacaactggagtttgcaaactgcgtatcattttggagggtacgcaaagcacactgcagaattaattgactttatcaatagctttaaggagaccacaggaattctattagaccctgtttatactggtaaaatgctatttggaattttagacttaattaaaaatgacggttttgaggaagggagtcatattttagcaattcatacgggaggaatccaaggtattgaagggtttaaccaaaaattaatggataaaaacgaacaaatcatagccctttaa

SEQ ID NO: 265 - protein, 308 aa, Polaribacter irgensii
  Polaribacter irgensii 23-P
MIKETKNQQVILPILEEKKVTLFIKREDLIHPYVSGNKFRKLKYNLQEAKKLKKKSLLTFGGAFSNHILATAVAGKLAGFKTFGVIRGDELGKNLVKTLEGNATLRKAHENGMKLQFVTREQYRQKASFGFIEKMKNKWGDFYLIPEGGTNGLAVAGCEEILTKEDSEFNYICSAVGTGGTISGLIKSLQKHQKVIGFPALKGNFLSEEIKKYTIRKDNWSLQTAYHFGGYAKHTAELIDFINSFKETTGILLDPVYTGKMLFGILDLIKNDGFEEGSHILAIHTGGIQGIEGFNQKLMDKNEQIIAL

SEQ ID NO: 266 - DNA, 906 bp, Robiginitalea biformata
  Robiginitalea biformata HTCC2501
  CDS (1)..(906): transl_table=11
atgtcggaggcagccacctgcgagattgaccttcccatacttcgggagcgggacgtccggctttggatccgtcgggaagatgaattatttccgggtctgtccgggaacaaataccgaaaactcaagtacaacattcgggagatgcaacggggcgggcaccaaaccctgctcaccttcgggggtgccttttccaaccatatccacgccgtggctgccgcgggacggcagttcgggtttcgggccatcggagtcatccgcggggacgagctggcggtttcccccctgaaccctacgttggcggatgcccgggatgcaggcatgcatttgcattttgtctcccgtcgggactatgcccggcgacaatccccggaataccttcaggaactactggggcaatttggcccggcttacctgctcccggaaggggggacaaacccggcggccgtccggggctgtgccgaaatcctcggcgaggccgatgccggattcgaccgggtttgctgccccgtaggcaccgggggtaccctggccggactggcggctgcagcagtgccggggcagcaggtccgcggatatgcatcgctaaaggcatccggcctggaagccagcttgcgggactggattccggggaaacactggacactgtccggggagtttcattttggggggtatgcccgaatcgatgcccgcctggtccgttttatcaatgatttccgaaccgaaaccggggtgcccctggacccggtatatacgggcaaaatgctctacggcatcctggaggagacccgacgggggcagtttcaaccggggacgcggatcctcgccatccacaccggggggttgcagggaatccggggcatgaacctgaaattggggaaaaagggcttacctttgttgcaactatga

SEQ ID NO: 267 - protein, 301 aa, Robiginitalea biformata
  Robiginitalea biformata HTCC2501
MSEAATCEIDLPILRERDVRLWIRREDELFPGLSGNKYRKLKYNIREMQRGGHQTLLTFGGAFSNHIHAVAAAGRQFGFRAIGVIRGDELAVSPLNPTLADARDAGMHLHFVSRRDYARRQSPEYLQELLGQFGPAYLLPEGGTNPAAVRGCAEILGEADAGFDRVCCPVGTGGTLAGLAAAAVPGQQVRGYASLKASGLEASLRDWIPGKHWTLSGEFHFGGYARIDARLVRFINDFRTETGVPLDPVYTGKMLYGILEETRRGQFQPGTRILAIHTGGLQGIRGMNLKLGKKGLPLLQL

SEQ ID NO: 268 - DNA, 1008 bp, Marine actinobacterium
  Marine actinobacterium PHSC20C1
  CDS (1)..(1008): transl_table=11
atgggcattgcagactttgaacgctaccccctcaccttcggtcccagcccggtgcacccactccaacgcctgagcgcccacctcggcggagcgaccgtgtgggccaaacgagaagacgtaaatagcggcctagccttcggaggcaacaagacccgcaaactcgaatacattgttcccgacgccatcgcccagggcgcagatacactcgtttccatcggcggctaccagtccaaccacacacgtcaagttgccgcagtcgccgcaaagatcggcatgaaggctgtgcttgtgcaagaaaattgggtcgactggcccgacccgctcagcgaccgtgtcggcaacatccaactctctcgaatcatgggggcggatgttcggctcgacaactccggcttcgacatcggcattcgcgacagttggaaaaacgcgatcgctgatgtggaagcctctggcggcaagccgtacgccatcccggctggagcatccgaacaccacctgggcggtctcgggttcgcaaactgggcctacgaggtggaagtgcaagagcgtgaacttggagtgttctttgacacgatcgttgtttgcaccgtcaccggatcaacgcacgcgggaatgattgcaggctttgccgggcaagatcgcccacgccgtgtaatcggaatcgatgcctcagcgactctcgagaagacgcgagatcaagtcgcgaggatcgcacgtcacacagcgcaattgatcggtctcgaacgtgaactgcgggatgacgagatctcggttctcgaaggctgggctggcgacctctatggaatccccgtcgattcgactctcgaagcaatccgcttgggcggaacgcttgaaggaatgatcaccgacaccgtctacgagggaaagtctcttgccggcctcatcgagttagtctccagccgcgacattcctgcagacagcaacgtgctctacgctcacctcggtggccaactctcgctcaacgcctacagcggactatttcgctaa

SEQ ID NO: 269 - protein, 335 aa, Marine actinobacterium
  Marine actinobacterium PHSC20C1
MGIADFERYPLTFGPSPVHPLQRLSAHLGGATVWAKREDVNSGLAFGGNKTRKLEYIVPDAIAQGADTLVSIGGYQSNHTRQVAAVAAKIGMKAVLVQENWVDWPDPLSDRVGNIQLSRIMGADVRLDNSGFDIGIRDSWKNAIADVEASGGKPYAIPAGASEHHLGGLGFANWAYEVEVQERELGVFFDTIVVCTVTGSTHAGMIAGFAGQDRPRRVIGIDASATLEKTRDQVARIARHTAQLIGLERELRDDEISVLEGWAGDLYGIPVDSTLEAIRLGGTLEGMITDTVYEGKSLAGLIELVSSRDIPADSNVLYAHLGGQLSLNAYSGLFR

SEQ ID NO: 270 - DNA, 1005 bp, Desulfotomaculum reducens
  Desulfotomaculum reducens MI-1
  CDS (1)..(1005): transl_table=11
atgaacttagcaaaatttactcggagacgttacacagagggacaaacaccaattgagtttttacctaattttacaaaggctctagggggacccaacatctatattaaaagggatgaccaactaggattaacttctgggggtaataaaaccagaaagttggaattcttagtggcagatgctctggcacagggggctgatacccttattacctgcggagcagtacagtccaaccattgtcgacttaccctcgcggcagctgtgaaggaaggtttgaaatgcagattagttttagaagaaagggttcccggtagctataagccagaagccagcggaaacaactttttgtttaatctgctgggtgtagaaaaagttaaggttgtatcaggcggttcagatatgatgaaggaaatgcaaattgttgccgacgaattggccgccgaggggcgtaaggcctatataatccccggtggtggttcaaacgaaataggcagtttaggctatgttgcatgtgcacaggaaatttccgcccaactttttgaaaaaggtttaaagattgatcatattgttactcccagtggtagtgcaggaactcataccgggttggtaacaggattttacggtaacaactgtaatattccgataactgggattagcgttagccgtaaaaaacacgaacaagaagaattggtgtacagcgtaattcaaaaaactgccgcccttttagagataaaacaagaaatcccgagggaagctgtaagtgtatacgatgattatgttggccctggttattccttgcctactccggaaatggttgaagcggtacaactattggccagaacagaaggtattttgcttgaccctgtatacactggtaaagcaatgtctggcttaataggacttgttcgtaagggctttttcaagaaagaccagaatgtcctattcatccatactggtggttctcctgcgttatatgcttatacgtcaactatcctgggcaacgattaa

SEQ ID NO: 271 - protein, 334 aa, Desulfotomaculum reducens
  Desulfotomaculum reducens MI-1
MNLAKFTRRRYTEGQTPIEFLPNFTKALGGPNIYIKRDDQLGLTSGGNKTRKLEFLVADALAQGADTLITCGAVQSNHCRLTLAAAVKEGLKCRLVLEERVPGSYKPEASGNNFLFNLLGVEKVKVVSGGSDMMKEMQIVADELAAEGRKAYIIPGGGSNEIGSLGYVACAQEISAQLFEKGLKIDHIVTPSGSAGTHTGLVTGFYGNNCNIPITGISVSRKKHEQEELVYSVIQKTAALLEIKQEIPREAVSVYDDYVGPGYSLPTPEMVEAVQLLARTEGILLDPVYTGKAMSGLIGLVRKGFFKKDQNVLFIHTGGSPALYAYTSTILGND

SEQ ID NO: 272 - DNA, 1005 bp, Desulfotomaculum reducens
  Desulfotomaculum reducens MI-1
  CDS (1)..(1005): transl_table=11
atgaacttagcaaaatttactcggagacgttacacagagggacaaacaccaattgagtttttacctaattttacaaaggctcttgagggaccgaacatctatattaaaagggatgaccaactaggattaacttctgggggtaataaaaccagaaagttggaattcttagtggcagatgctctggcacagggggctgatacccttattacctgcggagcagtacagtccaaccattgtcgacttaccctcgcggcagctgtgaaggaaggtttgaaatgcagattagttttagaagaaagggttcccggtagctataagccagaagccagcggaaacaactttttgtttaatctgctgggtgtagaaaaagttaaggttgtatcaggcggttcagatatgatgaaggaaatgcaaattgttgccgacgaattggccgccgaggggcgtaaggcctatataattcccggtggtggttcaaacgaaataggtagtttaggatatgttgcatgtgcacaggaaattttcgcccaactttttgaaaaaggtttaaagattgatcatattgttactcccagtggtagtgcaggaactcataccgggttggtaacaggattttacggtaacaactgtaatattcctataactgggattagcgttagccgtaaaaaacacgatcaagaagaattggtgtacagcgtaattcaaaaaactgccgcccttttagagataaaacaagaaatcccgagggaagctgtaagtgtatacgatgattacgttggccctggctattccttgcctactccggaaatggttgaagcggtacaactattggccagaacagaaggtattttgcttgaccctgtatacactggtaaagcaatgtctggcttaataggacttgttcgtaagggctttttcaagaaagaccagaatgttctattcatccatactggtggttctcctgctttatatgcttacacgtcaactatcctgggcaacgattaa

SEQ ID NO: 273 - protein, 334 aa, Desulfotomaculum reducens
  Desulfotomaculum reducens MI-1
MNLAKFTRRRYTEGQTPIEFLPNFTKALEGPNIYIKRDDQLGLTSGGNKTRKLEFLVADALAQGADTLITCGAVQSNHCRLTLAAAVKEGLKCRLVLEERVPGSYKPEASGNNFLFNLLGVEKVKVVSGGSDMMKEMQIVADELAAEGRKAYIIPGGGSNEIGSLGYVACAQEIFAQLFEKGLKIDHIVTPSGSAGTHTGLVTGFYGNNCNIPITGISVSRKKHDQEELVYSVIQKTAALLEIKQEIPREAVSVYDDYVGPGYSLPTPEMVEAVQLLARTEGILLDPVYTGKAMSGLIGLVRKGFFKKDQNVLFIHTGGSPALYAYTSTILGND

SEQ ID NO: 274 - DNA, 924 bp, Oceanospirillum sp.
  Oceanospirillum sp. MED92
  CDS (1)..(924): transl_table=11
atgtttaaccctgtaagccttcctatttctcgtatcagcgatccggttttatctgctaatggtatttcgctggacatgctgcgccttgatcttactgatgaggtcatcagcggtaacaagtggtttaagttgaagtacaacctgatggatgcgaaaagccgtggttgtaaggctgtgctttcttttggtggtgcgtattcgaaccatatacatgccttagctaaagcaggtctggatctgggaattaggactataggggttatacgaggtgagcctgagtacgcaaagaacccaaccttgtcagatgccattgattgggggatggagctgcactttgtaaaccgcaaagattaccgtttgcggtcggatcctggtttcctaagtcatctgagggaacagtatgactgtccttatatcgtcccagagggtggaagcaatgctttggcacttaagggtgcgatggaaattctgccctcggagttaattgaatttgtttgccctgatcatgttatcctgccctgtggaaccggtggaaccctttcgggcatagcgctgagttgtagggatacgcctgtattaggtattcccgtcttaaagaatgcaggctttctctacgacgatatcagtgccttgatgggcttggtaacggataacgtgccggataactggtcattggatctggaggggcattttggtggctatgggaaggtcagtgatcagctgctgcaattcatgcagtcttttgaagtgaataatcagatccagctagatccaatctatacggctaagatgatgctgcggatttttcagcggatcgagcttggggaatatagccgtgggagccgtctattggcgatccataccggggggctgcaaggaagaaggggagcaggttgttcagcggtaccggctaattgcacataa

SEQ ID NO: 275 - protein, 307 aa, Oceanospirillum sp.
  Oceanospirillum sp. MED92
MFNPVSLPISRISDPVLSANGISLDMLRLDLTDEVISGNKWFKLKYNLMDAKSRGCKAVLSFGGAYSNHIHALAKAGLDLGIRTIGVIRGEPEYAKNPTLSDAIDWGMELHFVNRKDYRLRSDPGFLSHLREQYDCPYIVPEGGSNALALKGAMEILPSELIEFVCPDHVILPCGTGGTLSGIALSCRDTPVLGIPVLKNAGFLYDDISALMGLVTDNVPDNWSLDLEGHFGGYGKVSDQLLQFMQSFEVNNQIQLDPIYTAKMMLRIFQRIELGEYSRGSRLLAIHTGGLQGRRGAGCSAVPANCT

SEQ ID NO: 276 - DNA, 996 bp, Bacillus weihenstephanensis
  Bacillus weihenstephanensis KBAB4
  CDS (1)..(996): transl_table=11
atgaatttagctaaatttccgagaaaaaaatatacagaatcatatacaccaattgaaaaattaaacaatttttctgaagcacttggtgggccaactatttattttaaacgagatgatttacttggtttaacagctggcggtaataagacgagaaagttagagtttctagttgcggatgcacaggcaaagggtgcagatacgttaattacagctggtggtattcagtcaaaccattgccgtctaacacttgcagctgcggtaaaagaaaaaatgaaatgtattcttgtgctagaagaagggcttgagccagaagaaaagccagactttaacggaaactatttcttatatcatttattaggtgctgaaaacgtaattgttgtgccaaacggagcagatcttatggaagagatgcataaagtagcgaaagaagttagtgaaaaaggtaatacaccatatgtaataccagttggtggatcaaatcctactggtgcaatgggatacattgcttgtgcgcaagaaattatggcgcaatcattcgagcaaggaattgatttcagttcagttgtttgtgtaagtggtagcgctggtatgcatgctggtttaattactggtttttctggaacgcaaagcaaaattcctgtaatcggaattaacgtaagtagaggaaaagcggagcaagaagagaaagtagcaaaacttgtagatgaaacttcagctcacgttggtatcccaaactctatttcacgcgaggcagttacatgctttgatgaatatgtaggaccaggatacgctttaccaacaccagaaatggttgaagcagtacagttacttgcgaaaacagaaggtattttacttgacccagtttatacaggtaaagcagtagcaggattaattgatttaattagaaaaggcaaatttaataaagaagacaacattttattcgtacattcaggtggttcaccagctttatatgcgaatacgtctctatttgcgtaa

SEQ ID NO: 277 - protein, 331 aa, Bacillus weihenstephanensis
  Bacillus weihenstephanensis KBAB4
MNLAKFPRKKYTESYTPIEKLNNFSEALGGPTIYFKRDDLLGLTAGGNKTRKLEFLVADAQAKGADTLITAGGIQSNHCRLTLAAAVKEKMKCILVLEEGLEPEEKPDFNGNYFLYHLLGAENVIVVPNGADLMEEMHKVAKEVSEKGNTPYVIPVGGSNPTGAMGYIACAQEIMAQSFEQGIDFSSVVCVSGSAGMHAGLITGFSGTQSKIPVIGINVSRGKAEQEEKVAKLVDETSAHVGIPNSISREAVTCFDEYVGPGYALPTPEMVEAVQLLAKTEGILLDPVYTGKAVAGLIDLIRKGKFNKEDNILFVHSGGSPALYANTSLFA

SEQ ID NO: 278 - DNA, 996 bp, Xanthobacter autotrophicus
  Xanthobacter autotrophicus Py2
  CDS (1)..(996): transl_table=11
atggagcagcctgacatgcggctcatggagccggcgcgcctcgttctcaacccgaccaccacgccgcttttgcccgcgccccagctttcccaggcgctgggcggcccccagatctggatcaagcgtgacgacctgatcccgttcggctgcggcggcaacaagatccgcgggctcgagctcatcgtcgccgatgcgctgaaggccggcgccgacaccttggtgaccggcgccggcgtcctctccaaccacgtgcgcgcgacggcggcggcggcggccttctgcggcctcggcatgaccgccgtctactggggcgatccaccccggcagacgaggggcaatcacctgctgtcggtgctgtggggcgcgcagacccgcttcaccggatcgagcgaccgcaattcggtcgacgggatgctggaggtggaagccgccgacatccgggccgcgggtgggcggccttatgtgatcccgcgcggcggggcgtgcgccctcggcgtgatcggccatgtccaggccgtcggcgaggtcatggcgcagtgccgccaggcgggcatccggcccgattacgtggtgatggcggtcggctcgggcggcacgttggcgggctggctcctgggctcgcggctcctgggcgcctcctggcgggtggagggcatcacggtgagccggccggccgccgaggcgcgcgttcgcgtcaaggatctcgccgatcaggcggccgatcatctcggcctcggccgcgccgtgccggccgacgacgtgatcatccatgacggcttcatcggcgcgggctacggcatcgcctcgccggcgggcatgtccgcgctcgagcgggcggcgcgctgcgagggcgtggtgctggatcccgtctatacgggcaaggccatggccggctatggcgcgctggtcggggcagggcgctatggcgaggccgccaccgttctgttcctgcacagcggcgggctgcccagcctgttcgtcgatggaaccgcgtga

SEQ ID NO: 279 - protein, 331 aa, Xanthobacter autotrophicus
  Xanthobacter autotrophicus Py2
MEQPDMRLMEPARLVLNPTTTPLLPAPQLSQALGGPQIWIKRDDLIPFGCGGNKIRGLELIVADALKAGADTLVTGAGVLSNHVRATAAAAAFCGLGMTAVYWGDPPRQTRGNHLLSVLWGAQTRFTGSSDRNSVDGMLEVEAADIRAAGGRPYVIPRGGACALGVIGHVQAVGEVMAQCRQAGIRPDYVVMAVGSGGTLAGWLLGSRLLGASWRVEGITVSRPAAEARVRVKDLADQAADHLGLGRAVPADDVIIHDGFIGAGYGIASPAGMSALERAARCEGVVLDPVYTGKAMAGYGALVGAGRYGEAATVLFLHSGGLPSLFVDGTA

SEQ ID NO: 280 - DNA, 996 bp, Xanthobacter autotrophicus
  Xanthobacter autotrophicus Py2
  CDS (1)..(996): transl_table=11
atggaacagcctgacatgcggctcatggagccgccgcgtctcgtcctcaaccccaccgtcacgccgctgctgcccgcgccgcagctgaccggcacgctgggcggccccgagatctggatcaagcgcgacgacctgatcccgttcgggtgcggcggcaacaagatccgcggcctggagctcatcgtcgccgatgcgctgagagcgggcgccgacaccttggtgaccggcgccggcacgctctccaaccacgtgcgggcgacggcggcggcggcggccttcgccggcctcggcatgagcgccgtctattggggcgatccaccccagaaggcgaagggcaatcacctcctctcggtgctgtggggcgcgcggacccgcttcaccggatcgagcgaccgcaattccgtcgacgcgatgctggaggtggaggccgccgacatccgggccgcgggcgggcggccttatgtgatcccgcggggtggggcgtgcgcgcttggcgtgatcggccacgtccatgcggtgggcgaggtcatggcgcagtgccgccaggcgggcatccggcccgattgcgtggtgatggcggtcggctccgggggcaccttggcgggctggctcctgggctcgcggctcttgggcgcctcctggcgggtggaaggcatcacggtgagccggccggccgccgaggcccgcgtccgcgtcaaggatctcgccgatcaggcggccgatcatctgggccttgcccgctccgtcgcggccgacgacgtggtcatccacgacggcttcatcggcgcgggttacggcatcgcctcgcccgcgggcatgtccgcgatcgaacgcgcggcgcgctcagagggcgtggtgctggaccccgtctatacgggcaaggccatggccggctatggcgcgctgctcggcgcggggcgctatggcgatgccaccaccgttctgttcctgcacagcggcgggctgccaagcctgttcgtcgatggaaatgcgtga

SEQ ID NO: 281 - protein, 331 aa, Xanthobacter autotrophicus
  Xanthobacter autotrophicus Py2
MEQPDMRLMEPPRLVLNPTVTPLLPAPQLTGTLGGPEIWIKRDDLIPFGCGGNKIRGLELIVADALRAGADTLVTGAGTLSNHVRATAAAAAFAGLGMSAVYWGDPPQKAKGNHLLSVLWGARTRFTGSSDRNSVDAMLEVEAADIRAAGGRPYVIPRGGACALGVIGHVHAVGEVMAQCRQAGIRPDCVVMAVGSGGTLAGWLLGSRLLGASWRVEGITVSRPAAEARVRVKDLADQAADHLGLARSVAADDVVIHDGFIGAGYGIASPAGMSAIERAARSEGVVLDPVYTGKAMAGYGALLGAGRYGDATTVLFLHSGGLPSLFVDGNA

SEQ ID NO: 282 - DNA, 966 bp, Flavobacteria bacterium
  Flavobacteria bacterium BBFL7
  CDS (1)..(966): transl_table=11
atgaatctctttgatgttacaaatgcagttaaccaatcatttaaagattataatgacggtaaaacgcgagtagatataaaacgtgaagatttattacatgagttagtttctggtaataaattgcgcaaattaaaatacaatattttagaagcccagcgacaaggtcataataccttactaacttatggaggagcgttttctaatcatattgcagccacagcggctgctgggaatatttgtgggtttaagacgataggagttattagaggagaagaattaggtcataatctagagaaaacactaggcggaaacaagactttaagtaccgcacacgcattaggcatgcaatttaaatttgtatctcgttctaattatcgagaaaaatatgatgataaatttcagaaagttttaaacgcagagtatggacatgtatatcatattccggaaggaggaactaatcatcttgcagttaaaggaactgaagaaatcttaacagttaaggataaagattactatgattatatatgtgttgcagcaggaactggtggcactgcggctggaatcattaatagtacagcaccacatcaaaaagtactagtgttctctgcattaaaaggtgattttatgtttgatgaaattgctcggtacacacatcgtgaaaattttatggtgtttgatgaaaatagattcggtggttatgctaggtctagtgatggattgataaagtttatgaatggacgctttcgcgaaagcgtaacatcagaaaatcctaagggaataccacttgaacctatttataccggaaaaatgatgtatcgattagaacatcttgttaagactggcgttatatctggagaaactcgtattttagccatccatactggcggtttgcaaagtgtcacaggatacaatgcaatgctagaaaaaaaaggcaaaattaccttagattatatcaatgaaatttaa

SEQ ID NO: 283 - protein, 321 aa, Flavobacteria bacterium
  Flavobacteria bacterium BBFL7
MNLFDVTNAVNQSFKDYNDGKTRVDIKREDLLHELVSGNKLRKLKYNILEAQRQGHNTLLTYGGAFSNHIAATAAAGNICGFKTIGVIRGEELGHNLEKTLGGNKTLSTAHALGMQFKFVSRSNYREKYDDKFQKVLNAEYGHVYHIPEGGTNHLAVKGTEEILTVKDKDYYDYICVAAGTGGTAAGIINSTAPHQKVLVFSALKGDFMFDEIARYTHRENFMVFDENRFGGYARSSDGLIKFMNGRFRESVTSENPKGIPLEPIYTGKMMYRLEHLVKTGVISGETRILAIHTGGLQSVTGYNAMLEKKGKITLDYINEI

SEQ ID NO: 284 - DNA, 993 bp, Gamma proteobacterium
  marine gamma proteobacterium HTCC2207
  CDS (1)..(993): transl_table=11
atgattaattatccagagcggcttaacctggctcagacaccaacgccgttctatcctctagagcgactgtcaaaacagctcggcgggccgcgcatctggattaaacgcgatgatctcactggggctgccacctctggcaataaggtccgcaagctggagtttctgctcgcggaggccctcgctaaaggctgtgacaccttgatcacctctggtggtgtacagtccaatcactgccgttcagtggcgcttctcggtgctcagctgggcctcaaagtgcatctgttattgcgtgcagatattgagccaaagccagtgggcaatctactgctcgatcaattggccggagccactattagtcactacagtctcgatgagtaccgaggcttgaataagctctttaaccagtggcaagagcactatgctgcgcttggacgtaaagcttatgcaattcctactggtggcagtaatggtactggtatgtggggttatatagccgccgctgaggagctctctcaggactttcagcgccatgctatatctcctgcagccatagttcatgccaccggttctgcgggcacccaggcgggtttaatgctgggttgccaattgcatcagatcaatactcaggtaaaagcttatgcggtttgcgataacgctgagtatttcactcgcaaagtgcgcggagatctagagcaatggcagagtcattacagcccgcaaacggatatttcaggcctggtcgccgatacctctgatgagtatataggtccagcgtatggggttgccggtgaagaagtctttgagtgtattaaagaggttgctgctctagaaggtattttgctcgacccggtttataccggcaaagcattcttcggcatgatcgaagatatcaaaaaaggaaaattctcccaatgggacggtgatgatatcgtctttgtccacaccggagggctatttggattattcgctcaacagcatcgactgggctattag

SEQ ID NO: 285 - protein, 330 aa, Gamma proteobacterium
  marine gamma proteobacterium HTCC2207
MINYPERLNLAQTPTPFYPLERLSKQLGGPRIWIKRDDLTGAATSGNKVRKLEFLLAEALAKGCDTLITSGGVQSNHCRSVALLGAQLGLKVHLLLRADIEPKPVGNLLLDQLAGATISHYSLDEYRGLNKLFNQWQEHYAALGRKAYAIPTGGSNGTGMWGYIAAAEELSQDFQRHAISPAAIVHATGSAGTQAGLMLGCQLHQINTQVKAYAVCDNAEYFTRKVRGDLEQWQSHYSPQTDISGLVADTSDEYIGPAYGVAGEEVFECIKEVAALEGILLDPVYTGKAFFGMIEDIKKGKFSQWDGDDIVFVHTGGLFGLFAQQHRLGY

SEQ ID NO: 286 - DNA, 909 bp, Flavobacterium johnsoniae
  Flavobacterium johnsoniae UW101
  CDS (1)..(909): transl_table=11
atgaatccagttttcaatcaaaatataaatattcagtttccaaatcatatttcgctgactataaagcgtgaagatttaattcatccgtttgtttcgggaaataaattcagaaaactaaaatacaatttacttcaggcaaaagccgaaaacaaagatactttattgacttttggaggagctttttcgaaccatattgcggctgtggcttatgcaggaaaagaacaggggtttaaaacgattggaattattcgaggagatgaacttttggataaaatacaggaaaacccaaccttgaaatttgctcaggaaaacggaatgcagtttgagtttgtttcgcgagaggagtaccgtttaaaaaatgaaaagtcatttatagaaaagctgaaagagaagtttggtgatttttatttggttccggaaggaggaacaaatgaacttgctgtaaaaggctgcgaggagattttgacagaagaagattcggtttttaattacgtttgctgtgcggttggaacaggcggcacaatttcgggattaatcaataatgcattgccaaatcagaaaattttgggctttccagcgttaaaaggtgactttttaaacgatgaaattcgtatttttgcaaaaaaagataactggaatttaatttctgactatcattgtggaggttatggcaagataaatttagaattaattgaatttattaattctttttttgaagaaacaaaagtgcccttagatccaatttatacaggaaagatggtttttggcgttatagatttaataaacaaaaattattttcctgcgcattcaaaaattttactcattcacacaggcggattgcagggaattgacggaatgaatataaagttgaagcagaagaaattaccaatactcaaaaccaatgattaa

SEQ ID NO: 287 - protein, 302 aa, Flavobacterium johnsoniae
  Flavobacterium johnsoniae UW101
MNPVFNQNINIQFPNHISLTIKREDLIHPFVSGNKFRKLKYNLLQAKAENKDTLLTFGGAFSNHIAAVAYAGKEQGFKTIGIIRGDELLDKIQENPTLKFAQENGMQFEFVSREEYRLKNEKSFIEKLKEKFGDFYLVPEGGTNELAVKGCEEILTEEDSVFNYVCCAVGTGGTISGLINNALPNQKILGFPALKGDFLNDEIRIFAKKDNWNLISDYHCGGYGKINLELIEFINSFFEETKVPLDPIYTGKMVFGVIDLINKNYFPAHSKILLIHTGGLQGIDGMNIKLKQKKLPILKTND

SEQ ID NO: 288 - DNA, 951 bp, Psychroflexus torquis
  Psychroflexus torquis ATCC 700755
  CDS (1)..(951): transl_table=11
atgaatttacctatgttttccacctcttttttttctaaaaatttctcatcacctaaccaatttataggagagtttaatggcgttgaattatttgtaaaacgagaagatttaattcatcctatagtctcaggcaacaaatttagaaaacttaaatataatattctaaaaactcaggatgaaggatttactaaaatcctaacatttggtggagccttctcaaatcacattgcggcaacggcggaagcctgtcatattatcggtttaaagtctatcggaattatacgtggacaagaacttggagaagatttgcagaaaacactcgccagtaattcaactcttaattttgcattccaaaaaaacatggaattgttttttgtgaccagaaaagactacagacttaaagaacatattccctatattgaggatctatttaaatcggatttaactctttattctattccagaaggaggcactaacgctttagccataaaaggctgcactgaaatattaaccacagaagatgacaatttcgacgttatttgttcgtcggttgggactggtggaacagttgctggacttatagagggtacaaaatctcaccaacatgtcttaggtttttctgctttaaaagggaatttccttcaaaatgagatctccagatggacttcaaaatccaattggtcacttcaaaccgactttcattttggaggctatgctaaagtaaattcagaattgatagacttcataaattcctttcaaagtaaatatcaaattcaactggaccccatttataccgggaagatgttttacggcattttcgaattaatatcctcaggttttttttccaaaaatactcgtattttagcaattcatacgggaggccttcaaggtattgaaggtataaaccgtagcctaaaacaaaaaggacttcaaaccattacccttttatga

SEQ ID NO: 289 - protein, 316 aa, Psychroflexus torquis
  Psychroflexus torquis ATCC 700755
MNLPMFSTSFFSKNFSSPNQFIGEFNGVELFVKREDLIHPIVSGNKFRKLKYNILKTQDEGFTKILTFGGAFSNHIAATAEACHIIGLKSIGIIRGQELGEDLQKTLASNSTLNFAFQKNMELFFVTRKDYRLKEHIPYIEDLFKSDLTLYSIPEGGTNALAIKGCTEILTTEDDNFDVICSSVGTGGTVAGLIEGTKSHQHVLGFSALKGNFLQNEISRWTSKSNWSLQTDFHFGGYAKVNSELIDFINSFQSKYQIQLDPIYTGKMFYGIFELISSGFFSKNTRILAIHTGGLQGIEGINRSLKQKGLQTITLL

SEQ ID NO: 290 - DNA, 933 bp, Pseudomonas aeruginosa
  Pseudomonas aeruginosa PA7
  CDS (1)..(933)
ttgccgtttcccgactggtccccgcacgccaccctgcaacgcatcgaaaccgactggctggcccgcgccggggtcgaactggcgctgctgcgcctggaccaggtcgatccgctgatttccggcaacaagggtttcaagctcgccccgtacctggcgcaggcccgcgagcgcgggttggacggcctgatcagcctcggcggcgcccattccaaccacctgcatgcgctggccggcgccgctgcgcgtttcggcttccgctgcgtcggcctggtacgcggaaacgaagtcgatacgccgacggtacgcgacctgcgcagtctcggcatggaactgcactggctcggctacggcggctatcgccagcggcacgccggcggtttctgggcgccctggcgggagcgttatcccgggttgctgccggtcgccgagggcggtggcgggctgctgggcgcgcgtggttgcagcgggctggtggagcgcatagcgacccagttgccgacgctcggctgggacgattacgacgccgtctgggtggccgccggcaccggtacgacactggccggcctggtgcttggcgaggccgggcggcatccggtggtgggcgccctggcggtgccggaggaccacggcgtcgccgcgcaggtggcgacgactctcgccgcagcgggcgtcgccgatgccggctatcgcctgctggacgccagccgcggcggcttcgcccgcctcgatggcgcgctggcgcggttcatcgtcggcttcgagacggccagtggcgtcgccctggaaccgctgtacaccggcaagctgctgctcgccctgcgcggggcagtggagcgcggcgaggtggctcgtggcagccgcctggtggcgctacacaccggaggcctgcaggggcgccgggcgctgcaggagcgtctgctggcactgctctga

SEQ ID NO: 291 - protein, 310 aa, Pseudomonas aeruginosa
  Pseudomonas aeruginosa PA7
MPFPDWSPHATLQRIETDWLARAGVELALLRLDQVDPLISGNKGFKLAPYLAQARERGLDGLISLGGAHSNHLHALAGAAARFGFRCVGLVRGNEVDTPTVRDLRSLGMELHWLGYGGYRQRHAGGFWAPWRERYPGLLPVAEGGGGLLGARGCSGLVERIATQLPTLGWDDYDAVWVAAGTGTTLAGLVLGEAGRHPVVGALAVPEDHGVAAQVATTLAAAGVADAGYRLLDASRGGFARLDGALARFIVGFETASGVALEPLYTGKLLLALRGAVERGEVARGSRLVALHTGGLQGRRALQERLLALL

SEQ ID NO: 292 - DNA, 1020 bp, Rhizobium meliloti
  CDS (1)..(1020): transl_table=11
atgtcactgttggaaaagttcgaacgctacccgctcaccttcggcccgacgccgatcgagcacctgccgcggctgactgcggcgctgggcggcaaggtcgagatctatgccaagcgcgacgactgcaattccggcctcgccatgggcggcaacaagctcaggaagctcgaatatatcgtgcccgacgcgatcgcctccggcgcggatacgctggtgtcgatcggtggggtccagtcgaatcatacccgcatggtggctgcgactgcggcgaagatcggcatgaaatgtgtcgtcatccaggagaaatgggtaccgcactacgatgcggtctatgaccgtgtcggcaatatcctgatgacgaaactgatgggcgccgacagccggctggtcgaggatgggttcgacatcggcatccgcaagagttgggaggatgcgattcagtcggtagaggatgcgggcggcaagccctatgcgatcccggctggcgcttcggtacacaagttcggaggcctcggctatgtcggcttcgccgaggaagtcgcggcacaggagaaggacctcggcttcatcttcgactatatcatcgtttgcgttgtcaccggttcaacccagggcggaatgatcgtcggctttgccgcactagacagggccgaccgggtcattggcatcgatgcctcgggcaccctccagcagacgcgggatcaggtgcggaagatcgtcgatgccacctcggaactcgtgaaccttggtcggtcggtgcgtgaagacgagatcgtcatcaaccctgactacgcctatcccgcctatggagtgccctcggaggagaccaacgaggcgatccggctcgcggcgcgcaccgaggcgatgattaccgacccggtctatgagggaaagtcgatgcaggggatgatcgatctcgcgcgcaagggcttcttccccgagggctcgaaggtgctctacgcccatctcggcggcgccccggcgctcaacggctatagctattactacagggacggctga

SEQ ID NO: 293 - protein, 339 aa, Rhizobium meliloti
MSLLEKFERYPLTFGPTPIEHLPRLTAALGGKVEIYAKRDDCNSGLAMGGNKLRKLEYIVPDAIASGADTLVSIGGVQSNHTRMVAATAAKIGMKCVVIQEKWVPHYDAVYDRVGNILMTKLMGADSRLVEDGFDIGIRKSWEDAIQSVEDAGGKPYAIPAGASVHKFGGLGYVGFAEEVAAQEKDLGFIFDYIIVCVVTGSTQGGMIVGFAALDRADRVIGIDASGTLQQTRDQVRKIVDATSELVNLGRSVREDEIVINPDYAYPAYGVPSEETNEAIRLAARTEAMITDPVYEGKSMQGMIDLARKGFFPEGSKVLYAHLGGAPALNGYSYYYRDG

SEQ ID NO: 294 - DNA, 1056 bp, Aspergillus oryzae
  CDS (1)..(1056)
atgcccgacaccatccccctcccaccccccttctccaccatcccccgaacccccctaaccctgggcccctcgcccatccaccccctcccccgaataaccgccgacctgaaccaaaccgccaccatctacgccaaacgcgacgacctcaactccggcctcgcctacgggggcaacaagacccggaaactcgagtacctggccgccgacgccttagcccagaacgccacgacgctggtttccatcggcggcgtgcaaagcaaccacacacggcaggtggcggcggtggcggcgcgattggggctcaaggcgcggctggtgcaggagcattgggtggactgggaggatccggggtatgatgttgtggggaatattcagttgagtcggctgatgggggcggatgtaaggatggaggatgccgggtttgggattgagcataaggagacactgaagaagttgagggaggagtgtgaggggaatggggagcggccgtattatattcctgcgggggcgtcggatcatccgttgggtggattggggtttgcgaggtgggcgtttgaggtcagggagcaggagcgggagatgggggtggtgtttgatgatgtggtggtttgtgcggttacggggtccacgatggcgggcatggtcgctggctttaagttgattgagaagttgtatcccggggaaaagaagaagagggtcattggcattgatgggtcggcgaagcccgtggagacgaaggcgcaggtgttgcggattgccaggaacacggctgtgcagattggattgaaggaagaggatattaccgagaaggatatgattctcaatgaggactatcatgccggcacttatggcattcccgataaggcgacgtgggaggccattgagtatgccgcgcggatggaggcgtttattacggatccagtatacgagggaaagagttttgcgggaatggtggacttgattaagaaaggggagattacgggcaatgtgctgtatgcgcatctgggtgggcagttggccctcaacgcttactcgcgccttggggagacgaaatag

SEQ ID NO: 295 - protein, 351 aa, Aspergillus oryzae
MPDTIPLPPPFSTIPRTPLTLGPSPIHPLPRITADLNQTATIYAKRDDLNSGLAYGGNKTRKLEYLAADALAQNATTLVSIGGVQSNHTRQVAAVAARLGLKARLVQEHWVDWEDPGYDVVGNIQLSRLMGADVRMEDAGFGIEHKETLKKLREECEGNGERPYYIPAGASDHPLGGLGFARWAFEVREQEREMGVVFDDVVVCAVTGSTMAGMVAGFKLIEKLYPGEKKKRVIGIDGSAKPVETKAQVLRIARNTAVQIGLKEEDITEKDMILNEDYHAGTYGIPDKATWEAIEYAARMEAFITDPVYEGKSFAGMVDLIKKGEITGNVLYAHLGGQLALNAYSRLGETK

SEQ ID NO: 296 - DNA, 1206 bp, Aspergillus oryzae
  CDS (1)..(1206)
atgtccttctctctcccagaaaccttcgcaaagctccccagataccctcttctatatccctacccctctcccattcatcctctcccagcactaaccagacacctcaatcacaaccccagatccgcccccgcagtctccctcttcgcaaagcgcgaagaccactcctccccactcgcctgtgcaggcaacaagtaccgcaaactcgagtatattgtccctgacatcctgtctaattcaagtttgcatggacccggagaaagatcagaagcaaaggctaccaccaccctggtgaccgagggtgctatccaaagcaatcatacagtgcaagtcgcctcggtagcgcgacgactcggactcgaagcaattgttattctccataaagctacaggaggcggtttaactgccagttcagataaggatgtttttctacgcacgggtaacgtgcaaattgcccggcttctaggagcggaggtgcggatgctcgaggatagttcgacggtggataacagtgacccgattacgcctattctggagggattgcgtgctcaggggaaggtgccctactggattccttcgggggctagtttgcatcccttgggtgggctggggtatgcgcggtgcgcatttgaaattgcggcgcaggaaaaggagcaactgggagaaaatggccggttcgattatgtatttgttgcgtgtgggagtggaagtaccgtgggaggcttgattgcggggttcaaattactgcagaaaatcgaggcacagcgacaggatgaaaatgcagagagggttattggtcgtaaggtcatcgggatcttgaattcccctaccaagccgcgagaatatcatgaaggtcgagtgctcaactttgcccggcgtgcggcatatctcattggactggaccctgagcgggacgtcacaccggaagatgtccagttagacgatcggtttgctggcacagcctacggagaactggaccagacatccaagaagaccctggcatttctagcgcaggaagaaggggtcatcgttgatcctgtgtacacagtcaaggttatgagaggcgtaatgcactgggtacaggtgggcgaactcatcagagactggtcacgccgccttgagagctcgcccagcgaaggtcgagtaaatgcactatttatccacaccggtgggcagtcggccctaagtgcgtatgcagacatcgagtga

SEQ ID NO: 297 - protein, 401 aa, Aspergillus oryzae
MSFSLPETFAKLPRYPLLYPYPSPIHPLPALTRHLNHNPRSAPAVSLFAKREDHSSPLACAGNKYRKLEYIVPDILSNSSLHGPGERSEAKATTTLVTEGAIQSNHTVQVASVARRLGLEAIVILHKATGGGLTASSDKDVFLRTGNVQIARLLGAEVRMLEDSSTVDNSDPITPILEGLRAQGKVPYWIPSGASLHPLGGLGYARCAFEIAAQEKEQLGENGRFDYVFVACGSGSTVGGLIAGFKLLQKIEAQRQDENAERVIGRKVIGILNSPTKPREYHEGRVLNFARRAAYLIGLDPERDVTPEDVQLDDRFAGTAYGELDQTSKKTLAFLAQEEGVIVDPVYTVKVMRGVMHWVQVGELIRDWSRRLESSPSEGRVNALFIHTGGQSALSAYADIE

SEQ ID NO: 298 - DNA, 1116 bp, Neurospora crassa
  CDS (1)..(1116)
atggccgacttactactccccgaaccgttcgccagcatccctcgggagccgctaacctttggaccttctccgatccagcctctcccccgcatctcccaagccctcggtggaaaggtcaacgtctttgctaaacgcgaggacctcaactccggtcttgcctttggaggcaacaagaccagaaagctagacagcttgactaacaagtccggcccctcggcccccagatacctcgtccccgacgccatctcccgaggctgcgacaccctcgtctccatcgggggcatccaatccaaccacacgcgccaagtcgccgccgccgcctccaagctcggcctgcacgccgctctcgtccaagaacactgggtccccgactggaccgatcccggctacgacaaagtcggcaacatccagctctcccggctgatgggggccgacgtccgtcttgaaccgctagccgggttcgggatcgagcacaagcagacgctggcgaaactcaaagatgatctggagaaggaggggagaaagccgtattatatcccggctggggcgtcggatcaccctcttggagggctggggttcgcgaggtgggcgtttgaggtggtggcgcaggaggaggagttggggattcatttcgacacggtggtggtctgtgcggtgacagggtcgacgatggcgggcatggtggccgggtttaagttggttgagatgttggaacgccactcggaaaggctgggcaaggtgaataagaggagggtgattgggattgatgcgtccgccaaggttgagcagacgagagcgcaggtgctgaggattgcgaaacagacagcggccaagattgggttgaaggaggaggatatcacggagtcggatatcgtgctggatgatcggtaccatgcgggggtttatggcgtgccggacgagaaaacgattgaggctatcaagtttggggcgcggacggaggcgttcattaccgatcccgtgtatgagggcaaaagtctggcgggcatgatggacatgattaagaatggggagattgaggcgggaagcaatgtgctgtatgcgcaccttggagggcaattggcactgaatgcgtactccgctttggggttggaataa

SEQ ID NO: 299 - protein, 371 aa, Neurospora crassa
MADLLLPEPFASIPREPLTFGPSPIQPLPRISQALGGKVNVFAKREDLNSGLAFGGNKTRKLDSLTNKSGPSAPRYLVPDAISRGCDTLVSIGGIQSNHTRQVAAAASKLGLHAALVQEHWVPDWTDPGYDKVGNIQLSRLMGADVRLEPLAGFGIEHKQTLAKLKDDLEKEGRKPYYIPAGASDHPLGGLGFARWAFEVVAQEEELGIHFDTVVVCAVTGSTMAGMVAGFKLVEMLERHSERLGKVNKRRVIGIDASAKVEQTRAQVLRIAKQTAAKIGLKEEDITESDIVLDDRYHAGVYGVPDEKTIEAIKFGARTEAFITDPVYEGKSLAGMMDMIKNGEIEAGSNVLYAHLGGQLALNAYSALGLE

SEQ ID NO: 300 - DNA, 1014 bp, Rhizobium loti
  CDS (1)..(1014): transl_table=11
atgctggaaaaattcgagcgttacccgctcacctttggacccacacccatcgagaagctcgaccggctcggcaagcatctgggcggcaacgtggagatctacgccaaacgcgaggactgcaactccggtctggcgttcggcggcaacaagctgcgcaagctcgaatacatcatccctgacgcgatcgcgtcagatgccgatacccttgtcaccatcggcggcgtgcagtccaaccacacgcggatggtcgccgccgttgccgccaagatcggcatgaaatgtctcctggtccaggagagctgggttccacatgaggatgtcgtctacgaccgggccggcaacattctcttgagccgcatcttgggcgcagaggtgcgtctggtcgacgatggctttgacatcggtatccgccgcagctgggaaaaagcgctctatgaggtcaaggcaaggggcggcaggccctatgcgataccggccggggcgtctgttcacccgaatggaggcctcggctatgtggggttcgcggaggaagtgcgcgcccaggaggaacagctcgggtttgccttcgactacatggtcgtttgcacggtcaccggttcaacgcacgccggcatgctcgtcggatttgccaaggacggtcggcagcgcaacgtgatcggtatcgatgcctctgctaccccggccaagaccaaggcgcaggtgcttagcattgcccgacatacagcgaccctcgtcgagctcggatcggaacttgccgaggatgacgtggtgttgctggaggactacgcgcacccgcggtacggcattccatccgaggaaaccaaggaggcgatccgtctgtgtgcgcggctcgagggtatgattaccgatcccgtctatgagggcaaatcgatgcaagggatgattgacctcgttcaaaaaggcttttttcctgagggctcgaggatactctacgcgcatctcggcggcgcgccggccatcaacggttatggctacacctttcgcaatggctga

SEQ ID NO: 301 - protein, 337 aa, Rhizobium loti
MLEKFERYPLTFGPTPIEKLDRLGKHLGGNVEIYAKREDCNSGLAFGGNKLRKLEYIIPDAIASDADTLVTIGGVQSNHTRMVAAVAAKIGMKCLLVQESWVPHEDVVYDRAGNILLSRILGAEVRLVDDGFDIGIRRSWEKALYEVKARGGRPYAIPAGASVHPNGGLGYVGFAEEVRAQEEQLGFAFDYMVVCTVTGSTHAGMLVGFAKDGRQRNVIGIDASATPAKTKAQVLSIARHTATLVELGSELAEDDVVLLEDYAHPRYGIPSEETKEAIRLCARLEGMITDPVYEGKSMQGMIDLVQKGFFPEGSRILYAHLGGAPAINGYGYTFRNG

SEQ ID NO: 302 - DNA, 1149 bp, Arabidopsis thaliana
  CDS (1)..(1149)
atgtctgcaacatccgtaccttcaatggcggattttctcaccaaaaaaccttactctcctccttcttgggcttctcatcttcgtccgcttccttctcacactttctccctcgctcaccttcctactccgatccatcgatggaatcttcctggtcttcctaatggcacagaactctggatcaagcgagatgatttcaccggaatggaattgagtggaaacaaagtacgaaaactcgaattcttaatggcggaagctgttgatcaacacgctgatactgtaatcactatcggcggtattcagagcaatcattgtcgtgctacagccactgcatctaactatcttaatctcaattctcatcttattctccgtacttccaagcttcttgctgatgaagatcctggattggttgggaatctccttgtcgagcgtctcgttggagctaatgttcatctaatctctaaagaagagtattcttccattgggagtgaggctcttactaatgctctgaaagagaaactggaaaaagaaggaaagaaaccctatgttattccagtcggtggatcgaactctttgggaacttggggttatatagaagcagcaagggaaattgaggagcagctgaattatagacccgatgacctgaaatttgatgatattgtggtagcatgtggcagtggtggtacaattgctggtatttcattggggtcttggttgggagctctaaaagccaaggttcatgctttctcggtttgcgatgatcctgattacttctatgactttgtccaagggcttctggatggacttcacgctggtgttaactctcgtgatatcgtcaacatccacaatgccaaaggaaaaggatatgccatgaacacgtcagaggagcttgagtttgtaaagaaagtagcaagttcaactggtgttattcttgatccggtttacagtgggaaagctgcgtatggtttgataaatgagatcaccaaagatcccaaatgttgggagggaaggaagatattgttcatacacactggtgggcttcttgggttgtatgataaggttgatcaaatggcatctctgatgggtaattggtcccggatggatgtttcagaatccgttccaagaaaagatggtgttgggaaaatgttctag

SEQ ID NO: 303 - protein, 382 aa, Arabidopsis thaliana
MSATSVPSMADFLTKKPYSPPSWASHLRPLPSHTFSLAHLPTPIHRWNLPGLPNGTELWIKRDDFTGMELSGNKVRKLEFLMAEAVDQHADTVITIGGIQSNHCRATATASNYLNLNSHLILRTSKLLADEDPGLVGNLLVERLVGANVHLISKEEYSSIGSEALTNALKEKLEKEGKKPYVIPVGGSNSLGTWGYIEAAREIEEQLNYRPDDLKFDDIVVACGSGGTIAGISLGSWLGALKAKVHAFSVCDDPDYFYDFVQGLLDGLHAGVNSRDIVNIHNAKGKGYAMNTSEELEFVKKVASSTGVILDPVYSGKAAYGLINEITKDPKCWEGRKILFIHTGGLLGLYDKVDQMASLMGNWSRMDVSESVPRKDGVGKMF

SEQ ID NO: 304 - DNA, 1083 bp, Penicillium citrinum
  CDS (1)..(1083)
atgacagacccaaacccagtcaccctcccaacccccttctccacaatcccccgaacccccctcctcctaggcccctcaccaatccaccccctcccccgcacaacagccgatctcgccaaaaacaacccccaccccctggtaacaatctacgccaaacgcgacgacctaaactccggctacgcctacgggggcaacaaaacccgcaagctagagtatctactcgcggacgcccaagcccaaggctgcacgaccctcgtctccatcggcggcgtgcaaagcaaccacacgcgccaagtcgccgccgtcgccgcacgctcgggcctaaaagcccgtctcgtgcaggagcactgggtcgactggacagacccgggctacgagagcacgggcaacatccagctgtcgcggctgatgggcgcggatgtgcggctcgacccgtccgggttcgggatcgagcataagaataccgtgcagagggttgtggaggaggcgaggggtgatggggagaaaccctactatattcctgctggggcgtcggaccatccgcttggtggacttgggtttgcgcggtgggcgtttgaggttcgggagcaggagggggagatgggggttttctttgatacggtgcttgtttgtgctgttacggggtcgacttttgccgggatgattgctgggtttaagttgcttgagcggttgtatcctgcggatgcgaagaggagggttgttgggattgatgcttcggcgacggttgaggcgacccgggcgcaggttttgaggattgcgaagaatactgctgctaagattgggcttagtgaggatgatattacggaggatgatgttatgcttgatgatcggtaccatgctggtatctatggtgttcctgatcgtcagacttgggatgcgattgagtacgcggcgaagatggaggcgtttattactgatcctgtctatgaagggaagagctttgccggcatgatggatatgattcgtcgtggggagatcaaggggggaaatatcctgtatgcgcacctcggtggacagttggctttgaatgcttactccgagcttggtcggaccaatgaatag

SEQ ID NO: 305 - protein, 360 aa, Penicillium citrinum
MTDPNPVTLPTPFSTIPRTPLLLGPSPIHPLPRTTADLAKNNPHPLVTIYAKRDDLNSGYAYGGNKTRKLEYLLADAQAQGCTTLVSIGGVQSNHTRQVAAVAARSGLKARLVQEHWVDWTDPGYESTGNIQLSRLMGADVRLDPSGFGIEHKNTVQRVVEEARGDGEKPYYIPAGASDHPLGGLGFARWAFEVREQEGEMGVFFDTVLVCAVTGSTFAGMIAGFKLLERLYPADAKRRVVGIDASATVEATRAQVLRIAKNTAAKIGLSEDDITEDDVMLDDRYHAGIYGVPDRQTWDAIEYAAKMEAFITDPVYEGKSFAGMMDMIRRGEIKGGNILYAHLGGQLALNAYSELGRTNE

SEQ ID NO: 306 - DNA, 1245 bp, Arabidopsis thaliana
  CDS (1)..(1245)
atgagaggacgaagcttgacactctcaagagtaaagctcgagcttgcgagaagaagcatgtctgcaacatccgtaccttcaatggcggattttctcaccaaaaaaccttactctcctccttcttgggcttctcatcttcgtccgcttccttctcacactttctccctcgctcaccttcctactccgatccatcgatggaatcttcctggtcttcctaatggcacagaactctggatcaagcgagatgatttcaccggaatggaattgagtggaaacaaagtacgaaaactcgaattcttaatggcggaagctgttgatcaacacgctgatactgtaatcactatcggcggtattcagagcaatcattgtcgtgctacagccactgcatctaactatcttaatctcaattctcatcttattctccgtacttccaagcttcttgctgatgaagatcctggattggttgggaatctccttgtcgagcgtctcgttggagctaatgttcatctaatctctaaagaagagtattcttccattgggagtgaggctcttactaatgctctgaaagagaaactggaaaaagaaggaaagaaaccctatgttattccagtcggtggatcgaactctttgggaacttggggttatatagaagcagcaagggaaattgaggagcagctgaattatagacccgatgacctgaaatttgatgatattgtggtagcatgtggcagtggtggtacaattgctggtatttcattggggtcttggttgggagctctaaaagccaagttgacagatggctcagttaagtttccattcattgtacaggttcatgctttctcggtttgcgatgatcctgattacttctatgactttgtccaagggcttctggatggacttcacgctggtgttaactctcgtgatatcgtcaacatccacaatgccaaaggaaaaggatatgccatgaacacgtcagaggagcttgagtttgtaaagaaagtagcaagttcaactggtgttattcttgatccggtttacagtgggaaagctgcgtatggtttgataaatgagatcaccaaagatcccaaatgttgggagggaaggaagatattgttcatacacactggtgggcttcttgggttgtatgataaggttgatcaaatggcatctctgatgggtaattggtcccggatggatgtttcagaatccgttccaagaaaagatggtgttgggaaaatgttctag

SEQ ID NO: 307 - protein, 414 aa, Arabidopsis thaliana
MRGRSLTLSRVKLELARRSMSATSVPSMADFLTKKPYSPPSWASHLRPLPSHTFSLAHLPTPIHRWNLPGLPNGTELWIKRDDFTGMELSGNKVRKLEFLMAEAVDQHADTVITIGGIQSNHCRATATASNYLNLNSHLILRTSKLLADEDPGLVGNLLVERLVGANVHLISKEEYSSIGSEALTNALKEKLEKEGKKPYVIPVGGSNSLGTWGYIEAAREIEEQLNYRPDDLKFDDIVVACGSGGTIAGISLGSWLGALKAKLTDGSVKFPFIVQVHAFSVCDDPDYFYDFVQGLLDGLHAGVNSRDIVNIHNAKGKGYAMNTSEELEFVKKVASSTGVILDPVYSGKAAYGLINEITKDPKCWEGRKILFIHTGGLLGLYDKVDQMASLMGNWSRMDVSESVPRKDGVGKMF

SEQ ID NO: 308 - DNA, 1014 bp, Bradyrhizobium japonicum
  CDS (1)..(1014): transl_table=11
atgctggaaaaattcgcgcgctatccgctgaccttcggcccgacgcccatcgagaagctggagcggctgtcgaaacatctcggcggcaatgtcgagatctatgccaagcgcgaggactgcaactccggcctcgcctatggcggcaacaagctgcgcaagctcgaatacatcatcccggacgcgatcgcctcgaacgccgacacgctggtctcgatcggcggcgtgcagtccaaccacacccgcatgatcgccgccgtcgccgccaagatcggcatgaagtgccgcctggtgcaggaagcgtgggtgccgcacgaggacgccgtctatgaccgcgtcggcaacatcatgctctcgcgcatcatgggcgccgacgtgcgcctggtcgacgacggcttcgacatcggcatccgcaagagctgggagcaggcgatcgaggaagtgaaggccgcgggcggcaagccttacgcgattcccgccggcgcctccgtgcacaaatatggcgggctcggctatgtcggcttcgccgaggaagtgcgtaagcaggaagccgagctcggcttcaagttcgactacatcgtggtctgcaccgtcaccggctcgacccatgccggcatgctggtcggcttcgccgccgacggccgcgcgcgaaaggtgatcggcatcgacgggtcgttcaccccggcgcagaccaaggcgcaggtgctctcgatcgcccagaacacggccaagctcgtcgagctcggcaaggacatcgtcgcagacgacgtcgtgctgatcgaggactacgcctatcccgcctatggcgtgccgtcggaagagaccaaggaggcgatccgcctcaccgcgcgtctcgaagccatgatcaccgaccccgtctacgagggcaagtcgatgcagggcctgatcgacctcacgcagaaaggctatttcgagaagggcgcgaaggtcctctacgcgcatctcggcggtgccccggcgctcaacggctacggctacgcgttcagaaacggctag

SEQ ID NO: 309 - protein, 337 aa, Bradyrhizobium japonicum
MLEKFARYPLTFGPTPIEKLERLSKHLGGNVEIYAKREDCNSGLAYGGNKLRKLEYIIPDAIASNADTLVSIGGVQSNHTRMIAAVAAKIGMKCRLVQEAWVPHEDAVYDRVGNIMLSRIMGADVRLVDDGFDIGIRKSWEQAIEEVKAAGGKPYAIPAGASVHKYGGLGYVGFAEEVRKQEAELGFKFDYIVVCTVTGSTHAGMLVGFAADGRARKVIGIDGSFTPAQTKAQVLSIAQNTAKLVELGKDIVADDVVLIEDYAYPAYGVPSEETKEAIRLTARLEAMITDPVYEGKSMQGLIDLTQKGYFEKGAKVLYAHLGGAPALNGYGYAFRNG

SEQ ID NO: 310 - DNA, 1017 bp, Burkholderia mallei
  CDS (1)..(1017): transl_table=11
atgaatctccagaaattttcgcgttatccgctgaccttcggcccgacgccgatccagccgctcaagcggctttccgcgcatctcggcggcaaggtcgagctgtacgcgaagcgcgacgactgcaacagcggcctcgcgttcggcggcaacaagacgcgcaagctcgaatacctgatcccggacgcgctcgcgcaaggctgcgacacgctcgtgtcgatcggcggcatccagtcgaaccagacgcgccaggtcgcggcggtggccgcgcatctcggcatgaagtgcgtgctcgtgcaggagaactgggtcaactatcacgacgccgtctacgatcgcgtcggcaacatccagatgtcgcgcatgatgggcgccgacgtgcgcctcgtgccggacggcttcgacatcggctttcgcaagagctgggaggacgcgctcgccgatgtccgcgcgaggggcggcaagccgtatgcgattccggccggctgctccgaccatccgctcggcggcctcggcttcgtcggctttgccgaggaagtgcgcgcgcaggaggccgagctcggtttccaattcgattacgtcgtggtgtgctcggtgacgggcagcacgcaggccgggatggtcgtcggcttcgcggcggacgggcgcgcggaccgcgtgatcggcgtcgacgcgtcggcgaagcccgcgcagacgcgcgagcagatccttcggatcgcgaagcataccgccgatcgcgtcgagctgggccgcgacatcacgagcgccgacgtcgtgctcgacgagcgcttcggcggccccgagtacgggctgccgaacgagggcacgctcgaggcgatccggctgtgcgcgaagctcgaaggcgtgctgaccgatcccgtctacgaaggcaagtcgatgcacgggatgatcgagaaggtgcggctcggcgaattcccggccggctcgaaggtgctgtacgcgcatctcggcggcgtgcccgcgctgaacgcgtacagctttttgttccgcgacggctga

SEQ ID NO: 311 - protein, 338 aa, Burkholderia mallei
MNLQKFSRYPLTFGPTPIQPLKRLSAHLGGKVELYAKRDDCNSGLAFGGNKTRKLEYLIPDALAQGCDTLVSIGGIQSNQTRQVAAVAAHLGMKCVLVQENWVNYHDAVYDRVGNIQMSRMMGADVRLVPDGFDIGFRKSWEDALADVRARGGKPYAIPAGCSDHPLGGLGFVGFAEEVRAQEAELGFQFDYVVVCSVTGSTQAGMVVGFAADGRADRVIGVDASAKPAQTREQILRIAKHTADRVELGRDITSADVVLDERFGGPEYGLPNEGTLEAIRLCAKLEGVLTDPVYEGKSMHGMIEKVRLGEFPAGSKVLYAHLGGVPALNAYSFLFRDG

SEQ ID NO: 312 - DNA, 1038 bp, Cryptococcus neoformans
  CDS (1)..(1038)
atgtctacgcccgcttacctaacaaagctcgagtctatccccaaggagaagttcctcttcggtccttctcccatctcataccttcccaatctcaccgccgttctcggtgggaaggtcaagctttacgccaagcgtgaggactgcaactccggcctggcctacggtggtaacaaagtccgaaagctggagtatctcgttgcggatgccaaggccaaaggttgtaacactctcgtctccgtcggtggtgtgcaatccaatcacaccagggctgtgaccgctgtggccgtcgcttctggactcaaagccgtcacagtgcaagagaagtgggtccccatcgacccccctctttactctgagacaggcaacatccttctctcccgattaatgggcggcgacgttagacttaaccaggagactttcgatatcagacacaaaaaggctaccgaagatgctttcaaggacgtggaagccaagggcggcaagccatactacatccctgctggcgcttctgaccacccactcggtggattgggtttcacaaactgggtcgttgagctcgccaagcaagaaaaagaactcggcgtcttcttcgacgtcgtcatcgtctgctccgtcactggttcttctcacgccggtaccgtcgtcggtgccgttgcagaaggaaggaagcgcaagattatcggtattgacgcgagtggtaagcccgaagcgacaagaaaccaggtcttgaagattgcaaggaatactgcggccttgttggatgagcgtttggagattaaggaggaggacgtcatcttggacgacaggttccacgctggtatctatggtattcctgacgatgagaccatcgccgccatgaagttggctgcccaaaccgatgcgttcatcaccgaccctgtatacgaaggcaagtccatggcgggaatgatccgacttgtgaaggaaggtgccattaaggaaggatcgaacgtgttgtatatccacctcggtggacaaccggcgttaaacgcctatagctcatatttccctcatgcttag

SEQ ID NO: 313 - protein, 345 aa, Cryptococcus neoformans
MSTPAYLTKLESIPKEKFLFGPSPISYLPNLTAVLGGKVKLYAKREDCNSGLAYGGNKVRKLEYLVADAKAKGCNTLVSVGGVQSNHTRAVTAVAVASGLKAVTVQEKWVPIDPPLYSETGNILLSRLMGGDVRLNQETFDIRHKKATEDAFKDVEAKGGKPYYIPAGASDHPLGGLGFTNWVVELAKQEKELGVFFDVVIVCSVTGSSHAGTVVGAVAEGRKRKIIGIDASGKPEATRNQVLKIARNTAALLDERLEIKEEDVILDDRFHAGIYGIPDDETIAAMKLAAQTDAFITDPVYEGKSMAGMIRLVKEGAIKEGSNVLYIHLGGQPALNAYSSYFPHA

SEQ ID NO: 314 - DNA, 1017 bp, Enterobacter cloacae
  CDS (1)..(1017): transl_table=11
atgaatctgaatcgttttgaacgttatccattgaccttcggtccttctcccatcacgcccttgaagcgcctcagtcaacatctggggggcaaggtcgagctgtatgccaaacgtgaagactgcaacagtggcctggcctttggtgggaacaagacgcgcaagctcgaatacctcattcccgaagcgatcgagcaaggttgcgatacgctggtctccatcggcggcattcagtcgaaccagacccgccaggtcgctgccgtcgctgcccacttgggcatgaagtgcgtgttggtgcaggaaaactgggtgaactattccgatgcggtgtatgaccgagtcggcaacatcgaaatgtcgcggatcatgggcgctgacgtgcggcttgacgccgctggcttcgatattggcatccggccaagttgggaaaaggccatgagcgatgtcgtggaacaggggggtaaaccgtttccgattccggcgggctgctccgagcatccctatggcggcctcggtttcgtcggctttgccaaaaaattgcggcagcaggaaaaggaactgggcttcaagtttaactacatcgtggtctgctcggtgaccggcagtacgcaggcgggcatggttgtcggtttcgcggctgacggtcgttctaagaatgtgattggtgtcgatgcttcggccaagccggaacagaccaaggcacagatcctgcgcatcgccagacacacggctgagctggtggagttggggcgcgagattacggaagaggacgtggtgctcgatacgcgtttcgcctacccggaatatggcttgcccaacgaaggtacattggaagcaatccgactgtgcggcagccttgaaggggtgctgacagatccggtgtacgaaggtaaatcgatgcacggcatgattgaaatggtccgtcgtggcgaattccctgaaggctccaaggtgctttacgcacacctgggtggggcgccggcgctgaacgcctacagcttcctattccgtgatggctga

SEQ ID NO: 315 - protein, 338 aa, Enterobacter cloacae
MNLNRFERYPLTFGPSPITPLKRLSQHLGGKVELYAKREDCNSGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVEQGGKPFPIPAGCSEHPYGGLGFVGFAKKLRQQEKELGFKFNYIVVCSVTGSTQAGMVVGFAADGRSKNVIGVDASAKPEQTKAQILRIARHTAELVELGREITEEDVVLDTRFAYPEYGLPNEGTLEAIRLCGSLEGVLTDPVYEGKSMHGMIEMVRRGEFPEGSKVLYAHLGGAPALNAYSFLFRDG

SEQ ID NO: 316 - DNA, 1017 bp, Pseudomonas fluorescens
  CDS (1)..(1017): transl_table=11
atgaacctgaatcgttttaaacgttatccgctgaccttcggtccttctccgatcacgcccttgaaacgcctcagcgaacacctgggcggtaaggtcgagttgtatgccaaacgtgaagactgcaacagtggcctggcctttggcggcaacaagacgcgcaagctcgaatacctgattcccgaggcgctcgaacagggctgcgacaccttggtgtccatcggcgggatccagtcgaaccagacccgccaggtcgccgctgtcgctgcccacctcggtatgaagtgtgtgctggtccaggaaaactgggtgaactactccgacgccgtgtatgaccgggtcggcaatatcgagatgtcccgcatcatgggggctgacgtacgactggacgctgcagggttcgacatcggtattcggcccagttgggagaaggccatgaacgacgtggtggaacggggtggcaagccgttcccgataccggcgggttgttccgaacatccctacggcgggcttgggttcgtcggctttgccgaggaagtgcgggaacaggaaaaacaactggggttcaagttcgactacatcgtggtctgctccgtgaccggcagtacccaggccggcatggtcgtcggttttgccgcggacggccgttcgaagaacgttatcggcattgatgcctcggccaagcccgagaagaccaaggcacagatcctgcgtatcgcccggcacaccgccgagctggtggaactggggcgtgagatcaccgaagacgacgtggtgctcgatacaccgttcgcctacccggaatatggtttgcccaacgaaggtacgctggaagccattcgcctgtgcggcagccttgaaggtgtgttgaccgacccagtgtatgaaggcaaatccatgcacgggatgatcgaaatggtccgccgtggcgagttccccgaaggctcgaaagtgctttacgcgcacctgggtggggcacctgcgctgaacgcctacagcttcctgttccgcaacggctga

SEQ ID NO: 317 - protein, 338 aa, Pseudomonas fluorescens
MNLNRFKRYPLTFGPSPITPLKRLSEHLGGKVELYAKREDCNSGLAFGGNKTRKLEYLIPEALEQGCDTLVSIGGIQSNQTRQVAAVAAHLGMKCVLVQENWVNYSDAVYDRVGNIEMSRIMGADVRLDAAGFDIGIRPSWEKAMNDVVERGGKPFPIPAGCSEHPYGGLGFVGFAEEVREQEKQLGFKFDYIVVCSVTGSTQAGMVVGFAADGRSKNVIGIDASAKPEKTKAQILRIARHTAELVELGREITEDDVVLDTPFAYPEYGLPNEGTLEAIRLCGSLEGVLTDPVYEGKSMHGMIEMVRRGEFPEGSKVLYAHLGGAPALNAYSFLFRNG

SEQ ID NO: 318 - DNA, 1017 bp, Pseudomonas putida
  CDS (1)..(1017): transl_table=11
atgaacctgaatcgttttgaacgttatccgttgaccttcggtccatcccccatcactcccttgaaacgcctcagcgagcacctgggcggcaaggtggaactgtatgccaagcgtgaagactgcaatagcggcctggccttcggcgggaacaaaacgcgcaagctcgaatatctgattcccgaggccatcgagcaaggctgcgacaccttggtgtccatcggcggtatccagtcgaaccagacccgccaggtcgctgcggtcgccgcccacttgggtatgaagtgtgtgcttgtgcaggaaaactgggtgaactactccgacgctgtatatgaccgcgtcggcaacatcgagatgtcgcggatcatgggagcggatgtgcggcttgatgctgcaggtttcgacattggaattcggccgagctgggaaaaggccatgagcgatgtcgtggagcgcggcggcaaaccgtttccaattccggcgggctgttccgagcatccctatggagggctcgggtttgtcggcttcgctgaggaagtgcggcagcaggaaaaggagttgggcttcaagtttgactacatcgtggtctgctcggtgaccggcagtacccaggccggcatggtcgtcggtttcgcggctgacggtcgctcgaaaaacgtgatcggggtcgatgcttcggcgaaaccggagcaaaccaaggcgcagatcctgcgtatcgctcgacataccgctgaactggtggagctggggcgcgaaatcactgaagaggatgtggtgctcgatacgcgtttcgcctatccggaatatggcttgcccaacgaagggacgctggaagcgattcgcctgtgcggcagtcttgagggggtgttgaccgatccggtctacgagggcaaatccatgcacggcatgattgaaatggtacgccgcggggaattccctgacggctccaaagttctttatgcccacctgggcggcgcacctgcgttgaacgcctacagcttcttgtttcgcaacggctga

SEQ ID NO: 319 - protein, 338 aa, Pseudomonas putida
MNLNRFERYPLTFGPSPITPLKRLSEHLGGKVELYAKREDCNSGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVERGGKPFPIPAGCSEHPYGGLGFVGFAEEVRQQEKELGFKFDYIVVCSVTGSTQAGMVVGFAADGRSKNVIGVDASAKPEQTKAQILRIARHTAELVELGREITEEDVVLDTRFAYPEYGLPNEGTLEAIRLCGSLEGVLTDPVYEGKSMHGMIEMVRRGEFPDGSKVLYAHLGGAPALNAYSFLFRNG

SEQ ID NO: 320 - DNA, 1017 bp, Pseudomonas sp
  CDS (1)..(1017): transl_table=11
atgaatctgaatcgttttgaacgttatccattgaccttcggtccttctcccatcacgcccttgaagcgcctcagtcaacatctggggggcaaggtcgagctgtatgccaaacgtgaagactgcaacagtggcctggcctttggtgggaacaagacgcgcaagctcgaatacctcattcccgaagcgatcgagcaaggctgcgatacgctggtttccatcggcggcatccagtcgaaccagacccgtcaggtcgctgccgtcgctgcccacttgggcatgaagtgcgtgttggtgcaggaaaactgggtgaactattccgacgcggtgtatgaccgcgtaggcaacatcgagatgtcgcggatcatgggcgctgatgtgcggcttgacgccgctggcttcgatattggcattcggccaagttgggaaaaggccatgagcgatgtcgtggaacagggtggcaaaccgtttccgattccagcgggttgctccgagcatccctatggcggcctcggtttcgtcggctttgccgaagaggtgcggcagcaggaaaaggaactgggcttcaagtttgactacatcgtggtctgctcggtgaccggcagtacgcaggcgggcatggttgttggtttcgcggctgacggtcgttcgaagaatgtgattggtatcgatgcttcggccaagccggaacagaccaaggcacagatcctgcgcatcgcccgacacaccgctgagttggtggagttggggcgcgagattacggaagaggacgtggtgctcgatacgcgttttgcctacccggaatatggcttgcccaacgaaggcacattggaagccatccgactgtgcggcagccttgaaggcgtgctgacagacccggtatatgaaggtaaatcgatgcacggcatgattgaaatggtccgtcgtggtgaattccccgaaggttccaaagtgctttacgcacacttgggtggggcgccggcgctgaacgcctacagcttcctgtttcgtaacggctaa

SEQ ID NO: 321 - protein, 338 aa, Pseudomonas sp
MNLNRFERYPLTFGPSPITPLKRLSQHLGGKVELYAKREDCNSGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVEQGGKPFPIPAGCSEHPYGGLGFVGFAEEVRQQEKELGFKFDYIVVCSVTGSTQAGMVVGFAADGRSKNVIGIDASAKPEQTKAQILRIARHTAELVELGREITEEDVVLDTRFAYPEYGLPNEGTLEAIRLCGSLEGVLTDPVYEGKSMHGMIEMVRRGEFPEGSKVLYAHLGGAPALNAYSFLFRNG

SEQ ID NO: 322 - DNA, 1017 bp, Pseudomonas syringae
  Pseudomonas syringae pv
  CDS (1)..(1017): transl_table=11
atgaacctcagcaagttcaaacgctaccctctgaccttcggcccctcgcccatcaccccgctgaaacgcttgagcgagcacctgggtggcaaggtcgatctgtacgccaagcgcgaagactgcaatagcggcctggcctttggcggcaacaagacccgcaagctggaatacctggtgccggaagccatcgagggcggctacgacacgctggtgtcgatcggcggcattcagtccaaccagacccgccaggtggcggcagtcgcggcgcatctgggcatgaagtgcgtgctggttcaggaaaactgggtcaactactccgatgcgctgtatgaccgggtcggcaacatcgaaatgtcgcgcatcatgggcgccgatgtgcgcctggactcggccggttttgatatcggcattcgcccgagctgggaaaaggccatggccgatgtagtcgaaagcggcggcaagccgttcccgattcctgcgggatgttcggaacatccctacggcggccttgggttcgtgcgctttgccgatgaagtacgccagcaagaagaagaactgggcttcaagttcgactacatcgtcgtctgctcggtcaccggcagcacccacgccggtatgctggtcggcttcgctgccgatggccgtgcgcaacgggtaatcggcatcgacgcctcggccaaaccggacaaaacccgcgagcaggtactgcgtatcgcccagaacaccgcaaaactggtcgacctgggccgcgaaatcaccgccgaagacgtggtgctcgacacccgctacgcctaccccgaatacggcctgcccaacgacggcaccctcgaagccatacgcctctgcgcccgcctcgaaggcgtgctgaccgacccggtctacgagggcaaatccatgcacggcatgatcgacatggtccgcaacggcgaattccccgaaggctcgaaagtgctctacgcgcacctgggcggcgtaccggcgctgaacgcgtacagctttttgttcaaggatggttga

SEQ ID NO: 323 - protein, 338 aa, Pseudomonas syringae pv
  Pseudomonas syringae pv
MNLSKFKRYPLTFGPSPITPLKRLSEHLGGKVDLYAKREDCNSGLAFGGNKTRKLEYLVPEAIEGGYDTLVSIGGIQSNQTRQVAAVAAHLGMKCVLVQENWVNYSDALYDRVGNIEMSRIMGADVRLDSAGFDIGIRPSWEKAMADVVESGGKPFPIPAGCSEHPYGGLGFVRFADEVRQQEEELGFKFDYIVVCSVTGSTHAGMLVGFAADGRAQRVIGIDASAKPDKTREQVLRIAQNTAKLVDLGREITAEDVVLDTRYAYPEYGLPNDGTLEAIRLCARLEGVLTDPVYEGKSMHGMIDMVRNGEFPEGSKVLYAHLGGVPALNAYSFLFKDG

SEQ ID NO: 324 - DNA, 1017 bp, Pseudomonas sp
  CDS (1)..(1017): transl_table=11
atgaacctgcaacgattccctcgttacccgctgactttcgggccgacgccaatccaaccgctagcgcgtctgagcaagcacctcggcggcaaagtgcatctgtatgcgaaacgcgaagactgcaacagcggcctggcgttcggtggcaacaagacacgcaagctcgaatatctgatccctgaagcgcttgctcagggttgcgacacgctcgtgtcgatcggcggcattcagtcgaaccagacgcgccaggtggcggccgtggcggctcatctgggcatgaagtgcgtgctggtgcaggagaactgggtcaactattcggacgcagtctacgaccgcgtcggcaacatccagatgtcgcgcattctcggcgccgatgttcgcctcgtgcccgacggcttcgacatcggttttcgcaggagctgggaggatgcgctggaaagcgtgcgggcggccggcggcaagccgtatgcgattccggcaggctgctcggatcacccgctcggcggcctgggtttcgtcggcttcgcggaggaggtgcgggcgcaggaagccgaattgggcttcaaattcgactatgtcgtcgtgtgttccgtgaccggcagcacgcaggccggcatggtggtgggcttcgccgctgacggccgcgccgatcgcgtgatcggcgtcgacgcttcggccaaacccgcgcagacgcgcgagcagatcacccgcatcgcgagacagaccgcggagaaagtcggcctggagcgcgatatcatgcgggccgacgtggtgctcgacgagcgcttcgcgggtccggaatacggattgccgaacgaaggcacgctggaagcgatccgcttgtgcgcgcgcacggagggcatgctgaccgatcccgtctacgaaggcaaatcgatgcacggcatgatcgaaatggtgcgcaacggcgaatttccggaaggctcgcgcgtgctgtatgcgcacctcggcggggtgccggcgttgaacggctacagctttatcttccgagacggctga

SEQ ID NO: 325 - protein, 338 aa, Pseudomonas sp
MNLQRFPRYPLTFGPTPIQPLARLSKHLGGKVHLYAKREDCNSGLAFGGNKTRKLEYLIPEALAQGCDTLVSIGGIQSNQTRQVAAVAAHLGMKCVLVQENWVNYSDAVYDRVGNIQMSRILGADVRLVPDGFDIGFRRSWEDALESVRAAGGKPYAIPAGCSDHPLGGLGFVGFAEEVRAQEAELGFKFDYVVVCSVTGSTQAGMVVGFAADGRADRVIGVDASAKPAQTREQITRIARQTAEKVGLERDIMRADVVLDERFAGPEYGLPNEGTLEAIRLCARTEGMLTDPVYEGKSMHGMIEMVRNGEFPEGSRVLYAHLGGVPALNGYSFIFRDG

SEQ ID NO: 326 - DNA, 993 bp, Pyrococcus abyssi
  CDS (1)..(993): transl_table=11
atgcatccaaaggttgatgcccttctttcgagatttccaaggataactttaattccctgggaaaccccaatccagtaccttcccagaataagtagggagctaggtgttgacgtttatgttaagagagatgacttaactggtcttggaatagggggaaataagataaggaagcttgagttcctcctaggggatgcattgtccagaggttgcgacacggtaataacgataggtgccgtccattcaaatcatgcctttgtgacggctttagcggctaaaaaacttggactgggtgcggtcctaatccttagaggtgaagaagtcctaaagggtaactatctccttgacaagctgatgggaattgaaacgaggatatacgaggcagataacagctgggagctaatgaaagttgctgaggaagttgccgaagaacttaagggggaaggaaagaagccatacataataccccctggtggggcatccccagttggaaccctcggttacattaggggagtaggtgagctgtacactcaggtaaagaagctaggacttaggattgacaccgtagttgatgcggttggaagcgggggaacgtacgctgggcttctcttggggtccgctatagttaatgcagagtggagcgtagttggaatagacgttagtagtgccaccgagaaagcgaaggagagggttaagaatttggttgaaaaaacaaaggaactcctgggaattaatgtgaaagttcaggaaccgaggatatacgattacggctttggagcttacgggaagatagttaaagaagttgcaaagctcataaaatccgttgggactatggagggcttgctgctggatcccgtttatactggaaaggcattctacggcctgatggatcttgcgaagaaaggagatctcggagagagcgttctctttatacacacgggtggtctcccagggatattccactatggtgaggaaatgcttgaattgttggtatga

SEQ ID NO: 327 - protein, 330 aa, Pyrococcus abyssi
MHPKVDALLSRFPRITLIPWETPIQYLPRISRELGVDVYVKRDDLTGLGIGGNKIRKLEFLLGDALSRGCDTVITIGAVHSNHAFVTALAAKKLGLGAVLILRGEEVLKGNYLLDKLMGIETRIYEADNSWELMKVAEEVAEELKGEGKKPYIIPPGGASPVGTLGYIRGVGELYTQVKKLGLRIDTVVDAVGSGGTYAGLLLGSAIVNAEWSVVGIDVSSATEKAKERVKNLVEKTKELLGINVKVQEPRIYDYGFGAYGKIVKEVAKLIKSVGTMEGLLLDPVYTGKAFYGLMDLAKKGDLGESVLFIHTGGLPGIFHYGEEMLELLV

SEQ ID NO: 328 - DNA, 1017 bp, Ralstonia solanacearum
  CDS (1)..(1017): transl_table=11
atgaacctgaacaagcatccccgccatccgctgaccttcggccccacgcccatccagccgctcaagcggctgtcggcccacctcggcggcaaggtcgagctttacgccaagcgtgaggactgcaacagcggcctggccttcggcggcaacaagacgcgcaagctcgaatacctggtgccggaggtgctggccggcggctacgacacactggtctcgatcggcggcatccagtcgaaccagacgcgccaggtcgcggcggtggccgcgcacctggggctgaagtgcgtgctggtgcaggagaactgggtcaactatgccgatgcggtctacgaccgggtgggcaacatcgagctgtcgcgcatcctgggcgcggacgtgcggctggacgcggccgggttcgacatcggcatccgcccgagctgggagcaggccatggaggacgtgcgccgcgcgggcggcaagccgttcccgatcccggccggctgctcggagcatccgctcggtggcctgggcttcgtcggctttgccgaggaggtgcgccagcaggaggccgagttcggtttccgcttcgactacatcgtggtgtgctccgtcacgggcagcacacaggcgggcatggtggtgggtttcgcggcggacgggcgcgccgaccgggtgatcggcatcgacgcatcggccaagccggagcagacgcgcgagcagatcctgcggatcgctcgcgataccgccaagctggtcgagctcggccgcgacatcacggaagacgacgtggtgctcgacacgcgctacggcggccccgaatacggcttgccgaacgaaggcacgctggaggcgatccggctgtgcgcgcgccaggagggcatgctgaccgacccggtgtacgagggcaagtcgatgcacggcatgatcgaccgggtgcgcggcggcgagtttcccgagggttcgcgcgtgctgtacgcccacctgggcggcgtgccggcgctcaatgcgtacagcttcctcttccgcaacggttga

SEQ ID NO: 329 - protein, 338 aa, Ralstonia solanacearum
MNLNKHPRHPLTFGPTPIQPLKRLSAHLGGKVELYAKREDCNSGLAFGGNKTRKLEYLVPEVLAGGYDTLVSIGGIQSNQTRQVAAVAAHLGLKCVLVQENWVNYADAVYDRVGNIELSRILGADVRLDAAGFDIGIRPSWEQAMEDVRRAGGKPFPIPAGCSEHPLGGLGFVGFAEEVRQQEAEFGFRFDYIVVCSVTGSTQAGMVVGFAADGRADRVIGIDASAKPEQTREQILRIARDTAKLVELGRDITEDDVVLDTRYGGPEYGLPNEGTLEAIRLCARQEGMLTDPVYEGKSMHGMIDRVRGGEFPEGSRVLYAHLGGVPALNAYSFLFRNG

SEQ ID NO: 330 - DNA, 1014 bp, Rhizobium loti
  CDS (1)..(1014): transl_table=11
atgctggaaaaattcgagcgttacccgctcacctttggactcacacccatcgagaagctcgaccggctcggcaagcatctgggtggcaaggtcgaaatctacgccaaacgcgaggactgcaactccggtctggcgttcggcggcaacaagctgcgcaagctcgaatacgtcatccccgacgcgatcgcgtcagatgccgataccctggtcaccgtcggcggcgtgcagtccaaccacacgcgcatggtcgccgccgtcgccgccaagatcggcatgaagtgtctcctggttcacgagagctgggttccacatgaggatgtcgtctacgaccgggtcggcaacattctcttgagccgcatcttgggcgcagaggtgcgtctggtcgacgatggctttgacatcggtatccgccgcagctgggaaaaagcgctctatgaggtcaaggcaaggggcggcaggccctatgcgataccggccggggcgtctgttcacccgaatggaggcctcggctatgtggggttcgcggaggaagtgcgcgcccaggaggaacagcttgggtttgccttcgactacatggtcgtttgcacggtcaccggttcaacgcatgccggcatgctcgtcggattcgccaaggacggtcggcagcgcaacgtgatcggtatcgatgcctctgctaccccggccaagaccaaggcgcaggtgcttagcattgcccgacatacggcgaccctcgtcgagctcggatcggaacttgccgaggatgacgtggtgttgctcgaggactacgcgcacccgcggtacggcattccatccgaggaaaccaaggaggcgatccgtctgtgtgcgcggctcgagggtatgattaccgatcccgtctatgagggcaaatcgatgcaagggatgattgacctcgttcaaaaaggtttttttccagcgggctcgaggatactttacgcgcatctcggcggcgcgccggccatcaacggttatggctacacctttcgcaatggctga

SEQ ID NO: 331 - protein, 337 aa, Rhizobium loti
MLEKFERYPLTFGLTPIEKLDRLGKHLGGKVEIYAKREDCNSGLAFGGNKLRKLEYVIPDAIASDADTLVTVGGVQSNHTRMVAAVAAKIGMKCLLVHESWVPHEDVVYDRVGNILLSRILGAEVRLVDDGFDIGIRRSWEKALYEVKARGGRPYAIPAGASVHPNGGLGYVGFAEEVRAQEEQLGFAFDYMVVCTVTGSTHAGMLVGFAKDGRQRNVIGIDASATPAKTKAQVLSIARHTATLVELGSELAEDDVVLLEDYAHPRYGIPSEETKEAIRLCARLEGMITDPVYEGKSMQGMIDLVQKGFFPAGSRILYAHLGGAPAINGYGYTFRNG

SEQ ID NO: 332 - DNA, 1020 bp, Rhizobium leguminosarum bv
  Rhizobium leguminosarum bv
  CDS (1)..(1020): transl_table=11
atgtcactgttggaaaagttcgaacgctacccgctcaccttcggcccaacgccgatcgagcacctgccgcggctgactgcggcgctgggcggcaaggtcgacatctatgccaagcgcgacgactgcaattccggcctcgccatgggcggcaataagctcaggaagctcgaatatatcgtgcccgacgcgatcgcctccggcgcggatacgctggtgtcgatcggtggggtccagtcgaatcatacccgcatggtggctgcgactgcggcgaagatcggcatgaaatgtgtcgtcatccaggagaaatgggtaccgcactacgatgcggtctatgaccgtgtcggcaatatcctgatgacgaaactgatgggcgccgacagccggctggtcgaggatgggttcgacatcggcatccgcaagagctgggaggatgcgattcagtcggtagaggatgcgggcggcaagccctacgcgatcccggctggcgcttcggtacacaagttcggaggcctcggctatgtcggcttcgccgaggaagtcgcggcacaggaaaaggacctcggcttcatcttcgactatatcatcgtctgcgttgtcaccggttcaacccagggcggaatgatcgtcggctttgccgcactagacagggccgaccgggtgattggcatcgatgcctcgggcaccctccagcagacgcgggatcaggtgcggaagatcgtcgatgcgacctcggaactcgtgaaccttggtcggtcggtgcgtgaagacgagatcgtcatcaaccctgactacgcctatcccgcctatggagtgccctcggaggagaccaacgaggcgatccggctcgcggcgcgcaccgaggcgatgattaccgacccagtctatgagggaaagtcgatgcaggggatgatcgatctcgcacgcaagggcttctttcccgagggctcgaaggtgctgtacgcccatctcggcggcgccccggcgctcaacggctatagctattactacaaggacgggtga

SEQ ID NO: 333 - protein, 339 aa, Rhizobium leguminosarum
  Rhizobium leguminosarum bv
MSLLEKFERYPLTFGPTPIEHLPRLTAALGGKVDIYAKRDDCNSGLAMGGNKLRKLEYIVPDAIASGADTLVSIGGVQSNHTRMVAATAAKIGMKCVVIQEKWVPHYDAVYDRVGNILMTKLMGADSRLVEDGFDIGIRKSWEDAIQSVEDAGGKPYAIPAGASVHKFGGLGYVGFAEEVAAQEKDLGFIFDYIIVCVVTGSTQGGMIVGFAALDRADRVIGIDASGTLQQTRDQVRKIVDATSELVNLGRSVREDEIVINPDYAYPAYGVPSEETNEAIRLAARTEAMITDPVYEGKSMQGMIDLARKGFFPEGSKVLYAHLGGAPALNGYSYYYKDG

SEQ ID NO: 334 - DNA, 1017 bp, Schizosaccharomyces pombe
  CDS (1)..(1017)
atgggtttagaacagtttaagaaatatcccttgacctttggtcccactcctatcacctctatgaagagactatctaaaacattgggtggaaaagttgaaattttcgcaaagcgtgaggattgcaattcaggtctcgcatttggtggtaacaaaattagaaagttggaatatttaatccctgaagcaatcgatggtggctatgatacattagtctctattggtggtatacagtctaatcaaactaggcaagtcgcagctgttgctgctcatttgggcttggactgcgtattgattcaagaagactgggtcgactataaagacactatgtatgacagagtcggaaacattgaactttcccgaattgtcaacgctgacgttagattggacagctctaagtttgacattggcattcgaccatcatttaaaaatgctcttgaagagcttacaaagaagggcaagaagcctttcccaatccccgccggttgctcggaacatccctatggtggtctaggattcgtaggttgcgtagaggaaatttatgagcaagaaaaacaacttggattcaagtttgacaagatagttgtctgtaccgtaactggttcttcatttgctggtattatcgttggtatggcattgaccggaagacagaaagatgttattggaattgacgcttctgccactcctgaaaaaaccaaggcacaggttttaaggattgcacaaaacactgccaaacttattggattagaaaaggaattgactgagagcgatgtcaatattgacacaagatttgctcatcccgcttatggaattccaaatgaaggcaccatagaagctatcaagttatgtggtgctacggaaggtgtcttgactgatccagtttatgaaggcaagtctatgcaaggtcttattcatcttgtgagaaataacgaaattgctgaaggttctaaagttctttacatccatttaggaggtgcacctgccttgtcagcctatagtgcatattttaaaaatacctaa

SEQ ID NO: 335 - protein, 338 aa, Schizosaccharomyces pombe
MGLEQFKKYPLTFGPTPITSMKRLSKTLGGKVEIFAKREDCNSGLAFGGNKIRKLEYLIPEAIDGGYDTLVSIGGIQSNQTRQVAAVAAHLGLDCVLIQEDWVDYKDTMYDRVGNIELSRIVNADVRLDSSKFDIGIRPSFKNALEELTKKGKKPFPIPAGCSEHPYGGLGFVGCVEEIYEQEKQLGFKFDKIVVCTVTGSSFAGIIVGMALTGRQKDVIGIDASATPEKTKAQVLRIAQNTAKLIGLEKELTESDVNIDTRFAHPAYGIPNEGTIEAIKLCGATEGVLTDPVYEGKSMQGLIHLVRNNEIAEGSKVLYIHLGGAPALSAYSAYFKNT

SEQ ID NO: 336 - DNA, 939 bp, Thermotoga maritima
  CDS (1)..(939): transl_table=11
atgagaatcgatctttcccttaaacccacacctgttcagtttctcaaaagactttcggaaaaatacgggttcaacatctacgttaaaagagacgatctcacagagcttgtgggatcgggcaacaaaatcagaaagctggagtatcttctatgggaagctcttaaaaaaggagcaacgactgtcttcacctgtggaggtcttcagtcgaaccatgccagagcaacggcatacgtttcgagaagatacggcttgaaacctgttctcttcctcagaaaaggggagaaggtactgaacggaaatcttctcctcgacattctcctcggtgctgaaatagtggaggtatccccggaagagtacgaacgcatcgatgagatcttcgatgttcacaaaaagatgagagaaaagaaaggtgaaaaggtgtacgtgatacccgaagggggatcgaactcccttggagcctttggctacttcaatgcggtgctggagatgaaagatcaattgaacctcgaatctttcgatgctattgtgtgtgctgttggaagtggtggaaccatagcgggcttgtcagctggaatttcctttctggaatatcacgtacccgtagtgggtgtgaacgtcaccacgaaaaactcggattattttgtggggaaggtgaaaagaataattagtggtatggaagagtacggcctgagagtcaacgaaaccgttttcgaagtggtggacgattacagagggccgggatatgcgattccgtccagtgaggatgtggagatcttgaaagaagtagcttcgatagaaggcatcatcctcgatccggtctacacggcaaaagccttcagaggaatgatcgaaatgttcagaaactcagaaaagaacgttcttttcatccacacggggggaatattcggtctgttcgcgcagagcaggaggttggtataa

SEQ ID NO: 337 - protein, 312 aa, Thermotoga maritima
MRIDLSLKPTPVQFLKRLSEKYGFNIYVKRDDLTELVGSGNKIRKLEYLLWEALKKGATTVFTCGGLQSNHARATAYVSRRYGLKPVLFLRKGEKVLNGNLLLDILLGAEIVEVSPEEYERIDEIFDVHKKMREKKGEKVYVIPEGGSNSLGAFGYFNAVLEMKDQLNLESFDAIVCAVGSGGTIAGLSAGISFLEYHVPVVGVNVTTKNSDYFVGKVKRIISGMEEYGLRVNETVFEVVDDYRGPGYAIPSSEDVEILKEVASIEGIILDPVYTAKAFRGMIEMFRNSEKNVLFIHTGGIFGLFAQSRRLV

SEQ ID NO: 338 - DNA, 1017 bp, Variovorax paradoxus
  CDS (1)..(1017): transl_table=11
atgaacctgaagaaattcccccgccacgtcctgaccttcggccccacgccgatccagccgctgaagcgcctgagcgcccacctcggcggcaaggtcgatctctacgccaagcgcgaggactgcaacagcggcctggccttcggcggcaacaagacgcgcaagctggagtacctgattcccgaggcgctcgaaggcggctacgacacgctggtgtcgatcggcggcatccagtcgaaccagacgcggcaggtggccgcggtggctgcgcacctgggcctgaagtgcgtgctggtgcaggagaactgggtcaactactccgacgcggtgtacgaccgggtcggcaacatcgagatgtcgcgcatcatgggcgccgacgtgcgcttggacgcagccggcttcgacatcggcatccgccagagctgggaacaggccatggccgacgtgcgcgcggccggcggcaagcccttcccgattccggcgggctgctccgagcatccgcgcggtggcctcggctccgtgggctttgccgaagaagtgcgccagcaggaggccgaactcggcttcaagttcgactacctcgtggtctgctcggtcaccggcagcacgcaggccggcatggtggtgggcttcgcggccgacggccgcgccgaccgcgtgatcggcatcgacgcctcggccaagccgcagcagaccttcgaacaaatcttgcgcatcgcaaagaacacggccgagctggtcgagctgggccgcgacatcaccgagaaagacgtggtgctcgaccgccgcttcggcgggcccgagtacgggctgccgaacgaaggcacgctggaggccattcggttgagcgcgcgcttcgaaggcatgctgaccgaccccgtgtacgagggcaagtcgatgcacggaatgatcgagaaggtgcggctcggggagtttccggcgggctcgaaggtgctctacgcacacctgggcggcgtgccggcgctgaacgcctacagcttcctgttccgcaacggctga

SEQ ID NO: 339 - protein, 338 aa, Variovorax paradoxus
MNLKKFPRHVLTFGPTPIQPLKRLSAHLGGKVDLYAKREDCNSGLAFGGNKTRKLEYLIPEALEGGYDTLVSIGGIQSNQTRQVAAVAAHLGLKCVLVQENWVNYSDAVYDRVGNIEMSRIMGADVRLDAAGFDIGIRQSWEQAMADVRAAGGKPFPIPAGCSEHPRGGLGSVGFAEEVRQQEAELGFKFDYLVVCSVTGSTQAGMVVGFAADGRADRVIGIDASAKPQQTFEQILRIAKNTAELVELGRDITEKDVVLDRRFGGPEYGLPNEGTLEAIRLSARFEGMLTDPVYEGKSMHGMIEKVRLGEFPAGSKVLYAHLGGVPALNAYSFLFRNG

SEQ ID NO: 340 - DNA, 993 bp, Yersinia pestis
  CDS (1)..(993): transl_table=11
gtgacgcttcaacaaaaactgacgcaattcccgcgtctcgatctggtcggtaatgcgacgccattagaaaaactgtctcgtctatctgattatctgggacgtgaaatttacattaaacgtgatgatgtcacgcctgtggcgcttggcgggaataaactgcgcaagctagaattcttagccgcagatgccttgagacagggagccgatacgctggttacggctggtgctattcaatctaatcatgtccgccaaaccgccgccgtggccgcgaaactggggctgcattgcgttgcgctgttggaaaaccccattggtactgagcaggcaaactatctgaccaatgggaaccggctgttactggacctattcaatgttgatgttgtgatgtgtgaggcattgaacgatccaaatcagcaattagcagaattggctacccgcgtggaagcgcagggtttccgcccatatgtggtaccgattggcggttctaatgccttgggcgcgctgggttatgtgcagtgctcactggaaattgctgctcaagccgcgggcaatgttgcgtttagttcggtcgtcgtggcctctggcagtgcgggaacacatgcaggattggcggttggtctacagcagttgttacccgatgcggaattaatcggtgtgacggtatcacgtagtgccgatgaacagcggcctaaagtggcacagattcaacaagcgttggcgacatcattagggatgacggacccattggcaaaaatcaccttgtgggatagttattttgccccgcaatatgggatgccaaacgaagaggggatagcggctattaagctcttggcaagactggaaggaatattgttggaccctgtgtataccggtaaggcgatggcgggcttacttgatggtattgaacagcaaaaattctgcgacaaagggccaattttatttatccacactggcggggcacctgcgctgtttgcttatcatccgcaggtgtag

SEQ ID NO: 341 - protein, 330 aa, Yersinia pestis
MTLQQKLTQFPRLDLVGNATPLEKLSRLSDYLGREIYIKRDDVTPVALGGNKLRKLEFLAADALRQGADTLVTAGAIQSNHVRQTAAVAAKLGLHCVALLENPIGTEQANYLTNGNRLLLDLFNVDVVMCEALNDPNQQLAELATRVEAQGFRPYVVPIGGSNALGALGYVQCSLEIAAQAAGNVAFSSVVVASGSAGTHAGLAVGLQQLLPDAELIGVTVSRSADEQRPKVAQIQQALATSLGMTDPLAKITLWDSYFAPQYGMPNEEGIAAIKLLARLEGILLDPVYTGKAMAGLLDGIEQQKFCDKGPILFIHTGGAPALFAYHPQV

SEQ ID NO: 342 - DNA, 1406 bp, Glycine max
  CDS (68)..(1207)
gaattcccggatcgacgctttcgttgaattctaaaaggaaagaacagctgagctggtcagataatcaatggcatcatccttgggttttgagttcctgacgaagaagccttacagtcctccatcctgggcatcccatctccaccctttaccttcccacttcttctctcttgcccatcttcccactccaattcacagatggaaccttcccaatctgcccaccaataccgagctgtggatcaagcgagacgacctttccggaatgcagctgagtggtaacaaagtgaggaaattggagttcctgatggccgatgccattgcgcaaggcgccgactctatcatcacaatcggaggcattcagagcaaccactgtcgcgccaccgccgttgccgccaagtatttaaaccttgactgttttctcatcctccgcacttctgacctcctcgtcgatcaagatccaggacttactggcaatcttctcgtcgaacgtatggttggagctcacgttcacctcatctccaaacaagaatatgccaaaattggcagcgtgacactcaccaatgtcctaaaagaaaaattgatcaaggaagggaggaggccatatgttatacccgttggcggatcaaactctttgggaacatggggttatatagaagcagtacgggaaattgagcagcagattcagaaggggacaggcaatgtcaagtttgatgatattgttgttgcttgtggcagtggtggcacaattgctggtctgtcactaggatcgtcattgagtgcattgaaagcaagggtacatgcattctctgtttgtgatgacccagattacttccacaactttgctcaaggcttgcttgatggactcaaggctggcgttagctcaagagatattgtccacattcaaaacgccaagggtcttggctatgcaatgaatacatcggaggagcttaattttgtaaaagaagttgctgccactactggtgttgttcttgacccagtatacagtggtaaggctgcttatgcaatgctgaaagatatgtctgaaaatccaaagaagtgggaaaggagaaagatcctcttcatacatacgggtggcctcctaggattgtatgacaaggtcgatcagttggcttcttttgttgggaattggcaacgaatggatgtcaatgaatctgttcctaggcaggatggtattggaaagatgttctagagaaggaaaatgaaaaaacctgacgttgccagcatctatattttgtactatcttgctctaaataaattttatacttatatttaatagccatatgctcacactgaatcctgcctgaagttaccataagatagtaaagttccaaaaacttaagtgacaaataaatcaagttttatttatttttaaaaaaaaaaaaaaaaaa

SEQ ID NO: 343 - protein, 379 aa, Glycine max
MASSLGFEFLTKKPYSPPSWASHLHPLPSHFFSLAHLPTPIHRWNLPNLPTNTELWIKRDDLSGMQLSGNKVRKLEFLMADAIAQGADSIITIGGIQSNHCRATAVAAKYLNLDCFLILRTSDLLVDQDPGLTGNLLVERMVGAHVHLISKQEYAKIGSVTLTNVLKEKLIKEGRRPYVIPVGGSNSLGTWGYIEAVREIEQQIQKGTGNVKFDDIVVACGSGGTIAGLSLGSSLSALKARVHAFSVCDDPDYFHNFAQGLLDGLKAGVSSRDIVHIQNAKGLGYAMNTSEELNFVKEVAATTGVVLDPVYSGKAAYAMLKDMSENPKKWERRKILFIHTGGLLGLYDKVDQLASFVGNWQRMDVNESVPRQDGIGKMF

SEQ ID NO: 344 - DNA, 1315 bp, Brassica napus
  CDS (14)..(1138)
tgcagcaacacccatggcggattttctcacgaaaagtccttactctcctccttcgtgggcttctcatcttcgtccgcttccttcccacaccttctccctcgctcaccgtcctactccgatccatcgatggaacctccccggtctccccaacggcaccgaactctggatcaagcgagatgacttcacggggatggaattgagcgggaacaaagtccggaaactcgagttcctaatggccgacgccgtggagcagcaagccgacaccgtcatcaccatcggcggtatccagagcaaccactgccgcgccaccaccgtcgcttctaactacctcaatctggacactcatcttatcctccgcacctccaagcttcttgcggatggagatcctgggttggttgggaatctccttgttgagcgcctcgttggagctaacgttcatctcatctccaaggaagagtattcctccattgggagtgaggctctcactagtgccttgaaagagaagctggagaaagaagggaaaaagccttatgttattcccgttggtggatccaactctctgggaacttggggttatattgaagcagcaagggaaattgaggagcagcttaaatgtagaactgatagcctcaagtttgatgatattgtggttgcatgtggcagtggtggtacaattgctggtatttcattgggatcttggttgggagctcttaaagccaaggtccatgctttctcggtatgcgatgatcctgattacttttacgactttgtccaaggccttctggatggacttcaagctggtgttaactctcgcgatattgttagcatccacaatgccaagggaaaaggatatgcaatgaacacttcagaggagcttaagtttttaaaggacatagctagtgcaacaagtgtgattcttgatcctgtttacagtgggaaagctgcgtacggtttgataaatgagatgaccaaggatcccaaaagttgggaggggaagaagatattgttcatacacactggtgggcttcttgggttgtatgataaagttgatcaaatggcttctctgatgggaaactggagccgtatggatgttcaagaatccgtcccaagaaaagagggtgttgggaaaatgttctagcagaacaaaaacctgattctgtaataatcctgtgaagataagacaggttgaacacttgtttgtgcatttggtctgataaaaacgcatccattcatgtgatttctattctgtgtattatgtttaatagctatcgatgattaataaaatggtgggtccactctcaaaaaaaaaaaaaaa

SEQ ID NO: 345 - protein, 374 aa, Brassica napus
MADFLTKSPYSPPSWASHLRPLPSHTFSLAHRPTPIHRWNLPGLPNGTELWIKRDDFTGMELSGNKVRKLEFLMADAVEQQADTVITIGGIQSNHCRATTVASNYLNLDTHLILRTSKLLADGDPGLVGNLLVERLVGANVHLISKEEYSSIGSEALTSALKEKLEKEGKKPYVIPVGGSNSLGTWGYIEAAREIEEQLKCRTDSLKFDDIVVACGSGGTIAGISLGSWLGALKAKVHAFSVCDDPDYFYDFVQGLLDGLQAGVNSRDIVSIHNAKGKGYAMNTSEELKFLKDIASATSVILDPVYSGKAAYGLINEMTKDPKSWEGKKILFIHTGGLLGLYDKVDQMASLMGNWSRMDVQESVPRKEGVGKMF

SEQ ID NO: 346 - DNA, 1389 bp, Zea mays
  CDS (42)..(1229)
gtcgcttccgccgacacctgagtcttgtcgctgccgccgggatggccggagtcaccgccaccgggatggccggagttcccgccaccttctcctcagccaccgctcagatcgggggcttcctctcgaagaagccttacgcgccgccgttgtgggccacgcacctctcccccatgccttgccataccttctcgctcggccatttcccaacaccgattcacaagtggaatctgcccaatttgccggaaggaacggaagtgtggatcaagcgagacgatttatcaggcatgcagttgagtggaaacaaggtccggaagctggagttcttgatggcagatgccgtagcacaaggcgcagactgcgttattactgttgggggtatacagagtaaccactgccgtgccacagccgtggctgctaagtatctcaatcttgattgctacctgatactacgtacctccaagcttcttgtggataaggaccctggtttggttggcaatcttcttgtcgagagactagttggggcacacgttgatcttgtgtcaaaagaagaatatggaaaaattggtagtgtggctttagctgacctgctgaaaaaaaggcttctggaagaagggaggaagccgtatgtgattcctgttggtggatcaaactcattgggaacttggggatatattgaggcaataagggagattgagcagcaaattcagcaatctgctgatgttcagtttgatgatattgttgttgcatgtggcagtggtggaaccatcgctggccttgctttaggatccagattgagcagcttaaatacaaaagttcatgcattctctgtttgtgatgaccctgaatacttctatgactatatccaaggcctgattgatggacttaattctggtttggattcacatgatatagttagcatcgaaaatgctaaggggttaggctatgccatgaaaacagctgaggagcttaagtttgtcaaagacatagctgcatcaacaggcattatccttgatccagtctacagtgggaaggcggtttatggtttgctaaaagacatggctggcaatccagccaaatggaaaggtcgaaaagttctgtttatccacacaggtggtcttcttgggttgtatgataaggctgaccagttatcatctttggctgggagctggcgcagaatggatcttgaagattctgttccacgccaagatggcactggtaagatgttctgatcagtatggttcatgtgattccatgatggctcattcctgcaaacattgtatccattacagagttgttactcttatatttgtgcaagaaaatgcagaatagatggttcacattgtatagagcactgatgcaatttaagaataaagcacatcttttttgcca

SEQ ID NO: 347 - protein, 395 aa, Zea mays
MAGVTATGMAGVPATFSSATAQIGGFLSKKPYAPPLWATHLSPMPCHTFSLGHFPTPIHKWNLPNLPEGTEVWIKRDDLSGMQLSGNKVRKLEFLMADAVAQGADCVITVGGIQSNHCRATAVAAKYLNLDCYLILRTSKLLVDKDPGLVGNLLVERLVGAHVDLVSKEEYGKIGSVALADLLKKRLLEEGRKPYVIPVGGSNSLGTWGYIEAIREIEQQIQQSADVQFDDIVVACGSGGTIAGLALGSRLSSLNTKVHAFSVCDDPEYFYDYIQGLIDGLNSGLDSHDIVSIENAKGLGYAMKTAEELKFVKDIAASTGIILDPVYSGKAVYGLLKDMAGNPAKWKGRKVLFIHTGGLLGLYDKADQLSSLAGSWRRMDLEDSVPRQDGTGKMF

SEQ ID NO: 348 - DNA, 1429 bp, Zea mays
  CDS (284)..(1228)
gtcgcttccgccgacacctgagtcttgtcgctgccgccgggatggccggagtcaccgccaccgggatggccggagttcccgccaccttctcctcaaccaccgctcagatcgggggcttcctctcgaagaagccttacgcgccgccgttgtgggccacgcacctctcccccatgccttgccataccttctcgctcggccatttcccaacaccgattcacaagtggaatctgcccaatttgccggaaggaacggaagtgtggatcaagcgagacgattatcaggcatgcagttgagtggaaacaaggtccggaagctggagttcttgatggcagatgccgtagcacaaggcgcagactgcgttattactgttgggggtatacagagtaaccactgccgtgccacagccgtggctgctaagtatctcaatcttgattgctacctgatactacgtacctccaagcttcttgtggataaggaccctggtttggttggcaatcttcttgtcgagagactagttggggcacacgttgatcttgtgtcaaaagaagaatatggaaaaattggtagtgtggctttagctgacctgctgaaaaaaaggcttctggaagaagggaggaagccgtatgtgattcctgttggtggatcaaactcattgggaacttggggatatattgaggcaataagggagattgagcagcaaattcagcaatctgctgatgttcagtttgatgatattgttgttgcatgtggcagtggtggaaccatcgctggccttgctttaggatccagattgagcagcttaaatacaaaagttcatgcattctctgtttgtgatgaccctgaatacttctatgactatgtccaaggcctgattgatggacttaattctggtttggattcacatgatatagttagcatcgaaaatgctaaggggttaggctatgccatgaacacagctgaggagcttaagtttgtcaaagacatagctgcatcaacaggcattatccttgatccagtctacagtgggaaggcggtttatggtttgctaaaagacatggctggcaatccagccaaatggaaaggtcgaaaagttctgtttatccacacaggtggtcttcttgggttgtatgataaggctgaccagttgtcatctttggctgggagctggcgcagaatggatcttgaagattctgttccacgccaagatggcactggtaagatgttctgatcagtatggttcatgtgattccatgatggctcattcttgcaaacattgtatccattacagagttgttactcttatatttgtgcaagaaaatgcagaatagatggttcacattgtatagagcactgatgcaatttaagaataaagcacatcttttttgccatttggaaataaatattttttatgtggaaaaaaaaaaaaaaa

SEQ ID NO: 349 - protein, 314 aa, Zea mays
MQLSGNKVRKLEFLMADAVAQGADCVITVGGIQSNHCRATAVAAKYLNLDCYLILRTSKLLVDKDPGLVGNLLVERLVGAHVDLVSKEEYGKIGSVALADLLKKRLLEEGRKPYVIPVGGSNSLGTWGYIEAIREIEQQIQQSADVQFDDIVVACGSGGTIAGLALGSRLSSLNTKVHAFSVCDDPEYFYDYVQGLIDGLNSGLDSHDIVSIENAKGLGYAMNTAEELKFVKDIAASTGIILDPVYSGKAVYGLLKDMAGNPAKWKGRKVLFIHTGGLLGLYDKADQLSSLAGSWRRMDLEDSVPRQDGTGKMF

SEQ ID NO: 350 - DNA, 1383 bp, Zea mays
  CDS (42)..(1226)
gtcgcttccgccgacacctgagtcttgtcgctgccgccgggatggccggagtcaccgccaccgggatggccggagttcccgccaccttctcctcagccaccgctcagatcgggggcttcctctcgaagaagccttacgcgccgccgttgtgggccacgcacctctcccccatgccttgccataccttctcgctcggccatttcccaacaccgattcacaagtggaatctgcccaatttgccggaaggaacggaagtgtggatcaagcgagacgatttatcaggcatgcagttgagtggaaacaaggtccggaagctggagttcttgatggcagatgccgtagcacaaggcgcagactgcgttattactgttgggggtatacagagtaaccactgccgtgccacagccgtggctgctaagtatctcaatcttgattgctacctgatactacgtacctccaagcttcttgtggataaggaccctggtttggttggcaatcttcttgtcgagagactagttggggcacacgttgatcttgtgtcaaaagaagaatatggaaaaattggcagtgtggctttagctgacctgctgaaaaaaaggcttctggaagaagggaggaagccgtatgtgattcctgttggtggatcaaactcattgggaacttggggatatattgaggcaataagggagattgagcagcaaattcagcaatctgctgatgttcagtttgatgatattgttgttgcatgtggcagtggtggaaccatcgctggccttgctttaggatccagattgagcagcttaaatacaaaagttcatgcattctctgtttgtgatgaccctgaatacttctatgactatgtccaaggcctgattgatggacttaattctggtttggattcacatgatatagttagcatcgaaaatgctaaggggttaggctatgccatgaacacagctgaggagcttaagtttgtcaaagacatagctgcatcaacaggcattgtccttgatccagtctacagtgggaaggcggtttatggattgctaaaagacatggctggcaatccagccaaatggaaaggtcgaaaagttctgtttatccacacaggtggtcttcttgggttgtatgataaggctgaccagttgtcatctttggctgggagctggcgcagaatggatcttgaagattctgttccacgcaaagatggcactggtaagatgttctgatcagtatggtccatgtgattccatgatggctcattcttgcaaacattgtatccattacagagttgttactcttatatttgtgcaagaaaatgcagaatagatggttcacattgtatagaacactgatgcaatttaagaataaagcactctttct

SEQ ID NO: 351 - protein, 395 aa, Zea mays
MAGVTATGMAGVPATFSSATAQIGGFLSKKPYAPPLWATHLSPMPCHTFSLGHFPTPIHKWNLPNLPEGTEVWIKRDDLSGMQLSGNKVRKLEFLMADAVAQGADCVITVGGIQSNHCRATAVAAKYLNLDCYLILRTSKLLVDKDPGLVGNLLVERLVGAHVDLVSKEEYGKIGSVALADLLKKRLLEEGRKPYVIPVGGSNSLGTWGYIEAIREIEQQIQQSADVQFDDIVVACGSGGTIAGLALGSRLSSLNTKVHAFSVCDDPEYFYDYVQGLIDGLNSGLDSHDIVSIENAKGLGYAMNTAEELKFVKDIAASTGIVLDPVYSGKAVYGLLKDMAGNPAKWKGRKVLFIHTGGLLGLYDKADQLSSLAGSWRRMDLEDSVPRKDGTGKMF

SEQ ID NO: 352 - DNA, 1402 bp, Oryza sativa
  CDS (38)..(1192)
cattcccctccacgccgccgccgccgccgccgcgtggatggccggagtttccgccgcctccgccgccgggaagatcgggagcttcctctccaagaggccgtacgcgccgccgtcctgggcctcgcacctgtcccccgccccctcgcagaccttctcgctcggccatttcccgacgccgatccacaagtggaatctgcccaatttgccgaatggcacggaggtgtggatcaagcgagacgacatctcaggcatgcagttgagcgggaacaaggtccggaagctcgagttcctgatggcagatgccgtcgcgcagggcgctgactgcgttataactgtaggtggcatccagagcaatcactgccgtgccaccgcagtggctgcaaagtatataaatcttgattgttatctgatactgcgcacatccaagcttcttgtggataaggaccctggtttggttgggaatctccttgttgagagattggtgggagcgcatattgatcttgtttcaaaagaagaatatggaaaaattggcagtgtggctttagcggacttgctgaaaaagaagcttttggaagaaggccgaaaaccatatgttattcctgttggtggatcaaactctctaggaacttggggatatatagaagcaataagggagattgaacatcaaattcagatatcaggtgatgttcagtttgacgacattgttgttgcatgtggcagcggtggaaccattgctggtcttgctttaggatcaaaattgagtagcttaaaggcaaaagtccatgctttctctgtttgtgatgatcctggatatttccattcctatgttcaagacctgattgatggacttcattctgatttgcgttcacatgatttagtcaacattgaaaatgctaagggcttaggttatgccatgaacacagctgaggagcttaagtttgttaaagatatagctacagcaacaggcattgtccttgatccagtctacagtggaaaggcagcatatggaatgctgaaagacatgggtgctaatccagctaagtgggaagggcgaaaaattctttttgtacatacaggtggtcttcttggtttgtatgataaggttgatgagttatcatctttgagtgggagttggcgcagaatggatcttgaagaatctgttccacgcaaagatggaactggtaagatgttctgattgctatgctccaaaattgcttccattgttgttagaggtttcagacatctcattgtctaaaaagagtattcgcctcaatttgtacgacaaaattcaaagcagatggttaatgtaaaacactgtttgttatatttaaagaataaagcatatatttctgccatttggaaataaaggtttatatacatttgatgtaaaaaaaaaaaaaaa

SEQ ID NO: 353 - protein, 385 aa, Oryza sativa; identical to SEQ ID NO: 57

SEQ ID NO: 354 - DNA, 1406 bp, Glycine max
  CDS (68)..(1204)
gaattcccggatcgacgctttcgttgaattctaaaaggaaagaacagctgagctggtcagaaaatcaatggcatcatccttgggttttgagttcctgacgaagaagccttacagtcctccatcctgggcatcccatctccaccctttaccttcccacttcttctctcttgcccatcttcccactccaattcacagatggaaccttcccaatctgcccaccaataccgagctgtggatcaagcgagacgacctttccggaatgcagctgagtggtaacaaagtgaggaaattggagttcctgatggccgatgccattgcgcaaggcgccgactctatcatcacaatcggaggcattcagagcaaccactgtcgcgccaccgccgttgccgccaagtatttaaaccttgactgttttctcatcctccgcacttctgacctcctcgtcgatcaagatccaggacttactggcaatcttctcgtcgaacgtatggttggagctcacgttcacctcatctccaaacaagaatatgccaaaattggcagcgtgacactcaccaatgtcctaaaagaaaaattgatcaaggaagggaggaggccatatgttatacccgttggcggatcaaactctttgggaacatggggttatatagaagcagtacgggaaattgagcagcagattcagaaggggacaggcaatgtcaagtttgatgatattgttgttgcttgtggcagtggtggcacaattgctggtctgtcactaggatcgtcattgagtgcattgaaagcaagggtacatgcattctctgtttgtgatgacccagattacttccacaactttgctcaaggcttgcttgatggactcaaggctggcgttagctcaagagatattgtccacattcaaaacgccaagggtcttggctatgcaatgaatacatcggaggagcttaattttgtaaaagaagttgctgccactactggtgttgttcttgacccagtatacagtggtaaggctgcttatgcaatgctgaaagatatgtctgaaaatccaaagaagtgggaaaggagaaagatcctcttcatacatacgggtggcctcctaggattgtatgacaaggtcgatcagttggcttcttttgttgggaattggcaacgaatggatgtcaatgaatctgttcctaggcaggatggtattggaaagatgttctagagaaggaaaatgaaaaaacctgacgttgccagcatctatattttgtactatcttgctctaaataaattttatacttatatttaatagccatatgctcacactgaatcctgcctgaagttaccataagatagtaaagttccaaaaacttaagtgacaaataaatcaagttttatttatttttaaaaaaaaaaaaaaaaaa

SEQ ID NO: 355 - protein, 379 aa, Glycine max; identical to SEQ ID NO: 343

SEQ ID NO: 356 - DNA, 1463 bp, Triticum aestivum
  CDS (21)..(1280)
cccacgcgtccgaatcccccatgctcctgagaccggccctccccgtcgccgtcagttccactctcccactcttctcccatctcgccgccgtccgccgtcggtgctcaatcgccgccacgggcatggcaggagtctccgccgcctctcccgccgcagcacagatcggcagcttcctctccaagaagccctacgcgccgccgtcctgggcctcgcacctcgccctcgccccatcccacactttctccctcggccacttcccgaccccgattcacaaatggaatctgccaaatctgccggagggcactgaagtatggatcaagcgggacgatctgtcgggtatgcagctgagcgggaacaaggtccggaagctcgagtttctgttgtcagatgccgtcgcgcagggtgcggactgcgttatcactgtcggtggtatccagagcaaccactgccgtgcgacggcggtggctgccaagtatctcaatcttgactgttatttgatactgcgtacttccaagcttcttgtggatcaggaccctggtttggttggcaatctccttgttgagagactgttgggagcgcacattgatctcgtctcaaaagaagagtatgggaaaattggcagtgtggctttagcggacttgcttaaaaagaggcttttggaggaaggacggaagccatatgtgattcctgttggtggatccaattcacttggaacttggggatatattgaagcagtaagagagcttgagcagcaaattcagttatctggcgatgttcagtttgatgacattgttgttgcctgtggcagtggtggaaccattgctggtcttgctttaggatcaaaattgagtagcttaacggcaaaagtccatgctttctctgtttgcgatgaccctgaatacttctatgattatgttcaaggcctgattgatggactacaatctggcttggattcacatgatatagtcagcattcaaaatgctaagggcttaggttatgccatgaacacagctgaggagcttaagtttgttaaagatatagctactgcaacaggcattgtgcttgatccagtctacagtgggaagggagcatatgcaatgctgaaagacatggctgataatccatccaagtggaaagggcgaaaagtcctctttgtccacacaggtggccttcttgggttgtatgacaaggttgatcagatgtcatctttggctgggagctggcgaagaatggatcttgaagaatcagtcccacgcaaagatggcactggtaagatgttctgattgatatgctccagaaaccgctccattatgggctggagtttcagaaatgtcattcatcttaagggtatatgctcttacatttgtaaaagaaaattcagaatagacagctagcatggaatgttgatatacaagaataaagtgcatcgttctgccatttgaaaataaagctatctgtattgc

SEQ ID NO: 357 - protein, 420 aa, Triticum aestivum
MLLRPALPVAVSSTLPLFSHLAAVRRRCSIAATGMAGVSAASPAAAQIGSFLSKKPYAPPSWASHLALAPSHTFSLGHFPTPIHKWNLPNLPEGTEVWIKRDDLSGMQLSGNKVRKLEFLLSDAVAQGADCVITVGGIQSNHCRATAVAAKYLNLDCYLILRTSKLLVDQDPGLVGNLLVERLLGAHIDLVSKEEYGKIGSVALADLLKKRLLEEGRKPYVIPVGGSNSLGTWGYIEAVRELEQQIQLSGDVQFDDIVVACGSGGTIAGLALGSKLSSLTAKVHAFSVCDDPEYFYDYVQGLIDGLQSGLDSHDIVSIQNAKGLGYAMNTAEELKFVKDIATATGIVLDPVYSGKGAYAMLKDMADNPSKWKGRKVLFVHTGGLLGLYDKVDQMSSLAGSWRRMDLEESVPRKDGTGKMF

SEQ ID NO: 358 - DNA, 31 bp, Unknown
  AtACCD forward primer
ggggtcgacgaagcaatgagaggacgaagct

SEQ ID NO: 359 - DNA, 32 bp, Unknown
  AtACCD reverse primer
gggttaattaacagattttgttgtgctagaac

SEQ ID NO: 360 - DNA, 20 bp, Unknown
  NOS terminator forward primer
tccccgatcgttcaaacatt

SEQ ID NO: 361 - DNA, 25 bp, Unknown
  NOS terminator reverse primer
ccatctcataaataacgtcatgcat

We claim:

1. A method of increasing root length of a crop plant under normal or drought conditions as compared to a wild type variety of the plant, the method comprising the steps of:
 a) synthesizing an expression vector comprising a root-preferred Superpromoter and a polynucleotide encoding a polypeptide comprising amino acids 1 to 401 of SEQ ID NO:2;
 b) transforming cells of the plant with the vector produced in step a);
 c) regenerating transgenic plants comprising the polynucleotide from the transformed cell of step b);
 d) determining grain yield of the regenerated transgenic plants; and
 e) selecting transgenic plants which demonstrate increased grain yield as compared to a non-transgenic control plant.

2. The method of claim 1, wherein root growth is increased under normal conditions.

3. The method of claim 1, wherein root growth is increased under drought conditions.

4. The method of claim 1, wherein the polynucleotide comprises nucleotides 1 to 1246 of SEQ ID NO:1.

5. The method of claim 1, wherein the plant species is selected from the group consisting of maize, wheat, rye, oat, triticale, rice, barley, sorghum, millet, sugarcane, soybean, peanut, cotton, rapeseed and canola, manihot, pepper, sunflower, tagetes, potato, tobacco, eggplant, tomato, *Vicia* species, pea, alfalfa, coffee, cacao, tea, *Salix* species, oil palm, coconut, perennial grasses, wheatgrass, canarygrass, bromegrass, wildrye grass, bluegrass, orchardgrass, alfalfa, salfoin, birdsfoot trefoil, alsike clover, red clover, and sweet clover.

6. The method of claim 5, wherein the plant species is maize.

7. The method of claim 5, wherein the plant species is wheat.

8. The method of claim 5, wherein the plant species is rice.

9. The method of claim 5, wherein the plant species is sugarcane.

10. The method of claim 5, wherein the plant species is soybean.

11. The method of claim 5, wherein the plant species is cotton.

12. The method of claim 5, wherein the plant species is rapeseed or canola.

* * * * *